United States Patent 11,098,302 (IDENTIFICATION OF POLYNUCLEOTIDES ASSOCIATED WITH A SAMPLE) - sequence listing, part 42

SEQ ID NO: 142444 - DNA, 538 bp, Homo sapiens
  misc_feature: GYAE6OF02GE7O5.46.67.G01.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (395)..(395): a, c, t, g, unknown or other
  misc_feature (395)..(395): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtatccatcctccctgtctgcaaccgtgggagacagtgtcaccatcacttgccggnaagtcgaacnttgacactattaatgtatcacatagacaggacgcccctaagctctaatctatgctgctactcctagtttgactaaacggtcgggtacccagtcggaggttcaggtggcagtggatcgtaggacatatttcactctacaccatcgtagtactctcgactaacgtgtaagtntttcgactaacttattacgtgtacacagtaactactaattcgtttacgacgtacggtacacgtactaacaaattaaacgtacgtagtgtctagcctaacctntccgtacgttctactacttcctaccgctacgttcctagtac

SEQ ID NO: 142445 - DNA, 723 bp, Homo sapiens
  misc_feature: GYAE6OF02GN6ET.46.67.G01.1.454.CMB.1.raw
  modified_base (383)..(383): a, c, t, g, unknown or other
  misc_feature (383)..(383): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtcccctcacctgcgctgtctctggtcgcctcatcagtagttggtttctcgtgggctgggtccgcagcctccgagggagggctaggaatacagttggaagtcgtctctcataggtggtacggttcctattacacggttccgtctctacgagtacgtcgacgtcgacctatacttctcgtacggactacgtccgtaanctaaactcgttaccgtttttacccaggtaaacgtacgttacggtacgtttccgtaggttacccggacccgtcccggtacgttaccggaacccggttaacggggttaccgtttttaattaccggttcggtacggacgtaacggacggtaaccggttactttaagttacgttaggttttaacgtttttagggtacggtttttggtttaaccttttcgggaacctaacccgtgtaaccggttccggggaccggggttcctacccgggacccgggttcgggaccggaacggtacgttaccgtcgggttaccctaccgttccgtaccgttacgcccgttacccgg

SEQ ID NO: 142446 - DNA, 722 bp, Homo sapiens
  misc_feature: GYAE6OF02IMONI.46.67.G01.1.454.CMB.1.raw
  modified_base (654)..(654): a, c, t, g, unknown or other
  misc_feature (654)..(654): n is a, c, g, or t
tcagactagcagtacacgaccggtgctcgatttagagtatacatattgggtttgtcctcctgctggtggcagcgtcccagatgggtcctgtccctggtgcaactgcaggagtcggcccacgactggtgagggcctttcggacgacccctgtcccctcacctgcgctgtctctggtcgcctccatcagtagtggtttcttcgtggggctgggtccgcacgcctcccgagggaagggctaggaactacagttggagtcgtctcgtcagtacggtggtacgttccttaattacctacgtcccgtcgttacctacgaagtacgtcgacgttaccaaccgtaacttacgttaccgtaccgtgggtacccgtaccgtaccgaacgtacctaaacgtccgttaaccgtttttaccctaggtaaacgacgttacggtagttaccgttgtccgtaacccgccgtactcggtaaccgtacgggtttaaccgttttactaccggtttggtacgacggtaggtaacggtacggtacttaagtttacgttagttttacgttttgggaggtttacgttagttaccgaactacccgtagtacgtccgggtacgggtctacccggccgtcgggacgaggtaactcgtacgtacaccgttcttaccgtacncctaccgaccgaccggtctacgtccggttcccttacccgcgaccctaccgtcctacacgtccgacccg

SEQ ID NO: 142447 - DNA, 584 bp, Homo sapiens
  misc_feature: GYAE6OF02FRWN8.46.67.G01.1.454.CMB.1.raw
  modified_base (214)..(214): a, c, t, g, unknown or other
  misc_feature (214)..(214): n is a, c, g, or t
  modified_base (403)..(403): a, c, t, g, unknown or other
  misc_feature (403)..(403): n is a, c, g, or t
  modified_base (532)..(532): a, c, t, g, unknown or other
  misc_feature (532)..(532): n is a, c, g, or t
  modified_base (570)..(570): a, c, t, g, unknown or other
  misc_feature (570)..(570): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggcctttcggagaccctgtcccctcacctgcgctgtctcgtggtcncctcatcagtagtgtttctcgtaggggcttgggtccgcagcctccgagggagggctggatacagttggagtgtctctcagtgtgggtacgtaccgtataccgagttccgtcttctacaagacgttcgagttcgaaccagttactctacgtgacacgttccagtcaagtctacgttttcccagaaacgtntcgtatttccgtagtcgacccgtccgtctacgaccgtcgggttactttactacgttgcgtacgtagatacggcttatagttgtagttttaggagtttgttatttcgacctactagacgtcggcggtccncggtacccgtgggacccgtagacgtctaggtcaccgtntcttacgcctaccg

SEQ ID NO: 142448 - DNA, 632 bp, Homo sapiens
  misc_feature: GYAE6OF02ID4N2.46.67.G01.1.454.CMB.1.raw
  modified_base (315)..(315): a, c, t, g, unknown or other
  misc_feature (315)..(315): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatacaacatagaccgaggaccggcccctaagctacctaactctatgctgactactacctagtttnacgaaggtcgggtccagtcgtaggttcaggtggctaggtgtacgtcgtagggacagttactttacacttactactacctatactagttaactctacgtactaacgtgtaagttattttcgacttaactttattactgtaactaatagtaacttaacgtaagtttcgtttacggaaccgtaaagggaccaacgtaactaaactaaaacttaaacgtagttacgtacggtactacgacctacggtaacttccgttacggttacctttaacacccgtttcccgttaccccgaaccttcgttaccgtacgtacttaaccgg

SEQ ID NO: 142449 - DNA, 668 bp, Homo sapiens
  misc_feature: GYAE6OF02FHO3B.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtcncctcatcagtagtggtttctcgtgggctgggtccgcagcctcccgaggggagggctggaactcattggagttgtctctcagtaggtggaggttcctattacagtccgtctctcgaagtgtcgacgtccactatactctctggacacgtccagcaacttctacgttttcccagaagtctcgtagttctgtccgaccgccgctacgacgtaccgggtctttactactgtcgacgagacgacgtctagttagtgttagttttcgggagttggttacttaccgacctacccgttagtaccgtcgggaccggggtcctaccgggtaccccggtaggggacccgtaaaggggtaacttaccgttcgggtaccctacccggttccttacccgttacgtcccgtacccgtaacccggaaccgggtccctaaccgttcccggttaccccttcccccggtcggtacccctacccccgtaccctacccgaacggtaccgtaaccccgg

SEQ ID NO: 142450 - DNA, 687 bp, Homo sapiens
  misc_feature: GYAE6OF02HHCBP.46.67.G01.1.454.CMB.1.raw
  modified_base (482)..(482): a, c, t, g, unknown or other
  misc_feature (482)..(482): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgacaaccggtgggacgacagtcgtaccacctatcacgttcggcccgggacaaggtaccggaaactagttacgacctaaccttaagtttaaacttggtactacaactagtaacgaccgacgggaccggacccctaagccttactaatctatcgctgcactccgtagttacgacgtaagggtccgggtaccagttacggtaggttcgaggtggacgtagggttagagtcggtacgggaactagtactttcacctcctaccacctagtcgtaagttacttcgataacgtaacgtagtaaacgttnttttacgactttaacgttacttaccgtagtaacctaaacgtaacgttaaactttaacgtacgttttacgggttaaccggaaccggtaaaccgggtacctaaccggtaaacttaaaccgttaaaacgtaacgtaacgttcggtacgtactaccgaccgtactcgttctacgttcctacgtccgttccctacctcacttacattacg

SEQ ID NO: 142451 - DNA, 739 bp, Homo sapiens
  misc_feature: GYAE6OF02H87CH.46.67.G01.1.454.CMB.1.raw
  modified_base (160)..(160): a, c, t, g, unknown or other
  misc_feature (160)..(160): n is a, c, g, or t
  modified_base (419)..(419): a, c, t, g, unknown or other
  misc_feature (419)..(419): n is a, c, g, or t
  modified_base (468)..(468): a, c, t, g, unknown or other
  misc_feature (468)..(468): n is a, c, g, or t
  modified_base (548)..(548): a, c, t, g, unknown or other
  misc_feature (548)..(548): n is a, c, g, or t
tcagactagcagtacacgaccggtgctcgatttagagtatacatattgggtttgggggagtctcggtcaggacacagcatggacatgagggtccccgctcagctcctggggctcctgctactctggctcgaggtgccagatgtgacatcgagctgacccngtcctccatccctccctgtctcgaccgtaaccggtgggacgtactaggtacgtccaacctatactacgttcgggacccgggacaacgggtacggaaactagtttacggaaccctaactttaagttttaaaagttcgggtactaaccaaactagtaacggaaccggaacggggacccgaccccttaagcctactaaatctattcgctagtacacttcgtaggttcaacggaaggtcgggtacccagtcggtacgttacgnggtcgacgtggtacggtatcggtacggaactagtactttcacctttcanacctatacgtagttaactccgtagaacgtaacgtagtaaagtttcttagaacctttaacgttatacgagtttaaaccganaacgtttaacgtaactaggtttttaccgtaccgggtaaacggaaaggtaaccctaacggaaccttaaaaaggttaacccgttaaagacgggtttcgtacggtacctaacggtaccctaactcggtttactaccggttttacccttacggtaacctttcccccggtaaccttctacgtttagaaccgtttac

SEQ ID NO: 142452 - DNA, 605 bp, Homo sapiens
  misc_feature: GYAE6OF02GX2GA.46.67.G01.1.454.CMB.1.raw
  modified_base (97)..(97): a, c, t, g, unknown or other
  misc_feature (97)..(97): n is a, c, g, or t
  modified_base (192)..(192): a, c, t, g, unknown or other
  misc_feature (192)..(192): n is a, c, g, or t
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgacccagtctccatcctccctgtctgcaaccgtggganacagtgtccaccatcacttggccgggacaaggtcggaactnttcgacaccttatttaaagttggtatcaacatagaccgagggaccgccctaagcctcctaatctatgctgcatctagtttncgtaaagtcgggtcccagttcgaggttcaggtcgcgtagtcggatcggtagggacagtattttcgaccttctcacctatcaacttatcgtgactaacgcgtaagtcttttcggacttaacttattacgtacgttacaacgtagtaaattaacgtagtttacgtttacgggaccgtaagggtaacgtacctaaccgttaactaaaacgtttaaactaacgttaggtacgtactacgtacgtaccctagttaccttcgtcttacgtactccgttcccgactacttcgtatacg

SEQ ID NO: 142453 - DNA, 766 bp, Homo sapiens
  misc_feature: GYAE6OF02I4Y8D.46.67.G01.1.454.CMB.1.raw
  modified_base (171)..(171): a, c, t, g, unknown or other
  misc_feature (171)..(171): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgccctcacctgcgctgtctctggtncctccatcagtagtggtttcttcgtggggctgggtccggnacgcctaccgaggggagggctaggaatacagttggaagtcgtctctacagtcgtggtacgttcctattacgagttccgtcctactcgaaagcgtcgagtaccacgatactctcgtggaactccgtaccacgataacgttcgttacgttttacccaggaaggtactagtacttcgtggtaccgaccggtccacgtacgacgtacggggttacttttacgttacgtgggttacgcgtaacgtacggtaacggtacttaacgttagttggttacgttttagggtaggtttaggtttaacgtttcggaccttaaccgtacggtacggttaccgggtacggggtaccctacccggtaacccgggtacgggggtaccgtaacggggtaaacctttccgggtacggttacccgttaaccggttcccgttaccgtttacccggtacccgttaacccgacccggtaaacccgggtacccgttccggttaacccggttccccgtttacccccggtacggttccccccgtaccgttccccggtaaacccaccggtaccgtacccgg

SEQ ID NO: 142454 - DNA, 593 bp, Homo sapiens
  misc_feature: GYAE6OF02FH34E.46.67.G01.1.454.CMB.1.raw
  modified_base (194)..(194): a, c, t, g, unknown or other
  misc_feature (194)..(194): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctaccctgtcctgcaaccgtggganacagtcgtcaccatccacttgccgggtcaagtcggaacattgacacctattaaagttggtagtcaactattacgaccaggacgcccctaagctacctaatctatgctgcatcctagtttgcaaagtcggggtccagtcgtagttcaggtgctagtgatcgtggacagtattcgacttcncacctagtctaagtaactcgtagtaacgtagtaagtatttgacctaacttgtactgtacaacgtagtaacttactaattacggtttccgaccgtaagggaccgaacgtaactaacgtaaacgttaaaccgtaacgttagtacgtctacgacctaccgtacttcgttacgttccttaccgtacgttccgttaccccgacctacgttccttatacttaaccg

SEQ ID NO: 142455 - DNA, 840 bp, Homo sapiens
  misc_feature: GYAE6OF02H7B87.46.67.G01.1.454.CMB.1.raw
  modified_base (142)..(142): a, c, t, g, unknown or other
  misc_feature (142)..(142): n is a, c, g, or t
  modified_base (825)..(825): a, c, t, g, unknown or other
  misc_feature (825)..(825): n is a, c, g, or t
tcagactagcagtacacgaccggtgctcgatttagagtatacatattggggtttggggagtctcggtcaggacacagcatggacatgagggtccccgctcagctccgtggggctcctgctactctggctcggaggtgccagntgtgacatcgagtctacgacccgtagtcctaccacttccctcccgtgtctcgaccgaaccgggtgggacacgtagttcgtaccaccatccgtacgttcggccgggactaacgggtaccgggaaactacgttacgaacccttaaccttaaagttttaaaacgtttcggttaactaccaaaccgtaagtaaccggaaccggtaaccgggggacccggtaacccccgttaacgtccttaaccttaactacgttacgtacgtctgacctactaccgttaggtttacgacggtaaagggtccgggtacctaggtaccggtacggtttacgagggtggtaccgttaggtaggtcggtacggtacggaaccgttagttacgtttacacccgttactacccgtaaccgtagtaacgtaacgttaactcgtacggacgtaaacggttaaggtaaacgtttcgtttaacgaacctttaaaccgtttacgttaccttaacgtaaacgtaaccttaaagttaaaccgtttaactaaccggttttacggttaaccgggaaccgaaacgggtaaccaaaaccgttaactaaaaccgtaaaacgttaaaccggtatttaccgggaggtaccgtaccggaaccgtcctaacgttcgttaaccgttccttaccgttaccttcccggttacccctacgttntttaccgaacgttac

SEQ ID NO: 142456 - DNA, 746 bp, Homo sapiens
  misc_feature: GYAE6OF02HJO9S.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtgggagacagtcgtcaccatcacttcggccgggacaaggtcggaacattagactaccttaatttaattggtatcaacatacgaccagggaccgacccctaagctcctaatctatcgctgcatcctagtttcgacgtaaaggttccgggaccctaagtcggtaggttcgaggttcggacgtagggtggtaacgtcgtaggggactaacggttactttacctaacgttccctacctaaccctattaccgaagttaacgttacctacggtaccctaaagggtaccggtaaagtttagttttaaccgaacctttaaaacttttacgttaaccgttaacgtttaacccgtaaaacgtaacgttaaaattttaccgtaaagtttttcgggtttaaacccgggaacccggtaaacggggtaacctaaaccggtaaacctttaaaaacccggttaaaaaacgtttaaaccccggtaaaggttacggttaccggtacgtacgtaacgtaccctaggttcctacgttacgttacaccgttccttacccgtacctacgttctacgtacg

SEQ ID NO: 142457 - DNA, 647 bp, Homo sapiens
  misc_feature: GYAE6OF02GJEWR.46.67.G01.1.454.CMB.1.raw
  modified_base (210)..(210): a, c, t, g, unknown or other
  misc_feature (210)..(210): n is a, c, g, or t
  modified_base (352)..(352): a, c, t, g, unknown or other
  misc_feature (352)..(352): n is a, c, g, or t
  modified_base (417)..(417): a, c, t, g, unknown or other
  misc_feature (417)..(417): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgnagcctcccgaggggaagggctaggaatactagttggaagttgtctctcagtagtggaggttcctattacagtccgtctctacaagagtcgagtccacctatactctcgtggacacgtcagcaatctacgttttcccagaagnttagagttcgtgtcgaccgccgctgaccgtacgggtcttttatacgtgtagcgtagacgtacggnttaagttagtgttacgttttggagtttggtttactttaccgactacccgttagtacgttcgggacggggtcctaccggtaccccggtagggacccgtagggtaacttacggtcggtcctacccgttcgttaccttacgccctaccgaaccggtaaccggtccctaaccggttccgttccccgttccccgtcggtcccctaccccgtaccgtaccgaacgtaccgtacccg

SEQ ID NO: 142458 - DNA, 698 bp, Homo sapiens
  misc_feature: GYAE6OF02JSLRO.46.67.G01.1.454.CMB.1.raw
  modified_base (256)..(256): a, c, t, g, unknown or other
  misc_feature (256)..(256): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaagggctggaatactagttcgggaattgtctctntagtagtggtggttcctattacgagtccgtctctacaagtcgtcgacgtcaccatatctccgtggaccaccgtaccagacctaacttcgttaccggttttaccctaggtaaacgtagtacggttaacgttcttggtaccgtaaccggtcccggacgttacggaccgtaacgggttcgttttaacgtaccgtttgggtacgtcggtaacggtaggtaccggtactttacgttagttacggtttagttttcgggtaggtttacgttttacgtttacgtaccttaacctagtaccgtacgggtacggtccgtacccggtaccggtcgggacgtaggtacgtacgtcgtccaccgtcgttcgtaccgtcctccgaccgaccggtacctacggttcccgtcccttcccgtcgtaccctcccgttacccgtaccgtacgacgtacccg

SEQ ID NO: 142459 - DNA, 744 bp, Homo sapiens
  misc_feature: GYAE6OF02IM33J.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccactcctcctgtctgcaccgtggganacagtgtcacatcacttgccggcaagtcgaacattgactacctattaaattggtatcaacatacgaccgagggaccgacccctaagctacctaatctatcgctgcactccgtagtttgactaaacgggtcgggtacccagttcggtaggttcgaggtcggacgtaaggtcggagttaccggtgggggaactaacggttacgttttaccaccgttaccgtaacctaccctaagttaccgtaaaggttaacttcgtaacggtaaccgtaaaccggtttaaggaaacgtttacgttttacgaacctttaaaaccgttttactttaaccggttactaacgtaaaccgtaaagttaaactttaaacgttacgtttcgggttttaacccggaaccggtaaacgggtaacaaccgttaaacttaaaccgttaaaacgttaaaacgtaaaccggttcgttaaccggtaccgtacggtacccgtaacctacgttaccgtttacgttacctttaccgttacgtttccccttaacccgaccttaccggttacgtaccgttaaccg

SEQ ID NO: 142460 - DNA, 582 bp, Homo sapiens
  misc_feature: GYAE6OF02F58SU.46.67.G01.1.454.CMB.1.raw
  modified_base (291)..(291): a, c, t, g, unknown or other
  misc_feature (291)..(291): n is a, c, g, or t
  modified_base (449)..(449): a, c, t, g, unknown or other
  misc_feature (449)..(449): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctgtccctcacctgcgctgtctctggtgcctcatcagtagtggtttctcgtggggctgggtccggcagcgtccgagggaaggggctggaatacattggaagtgtctntcatagtggtaggttcctagttacagtccgtctctcaaggagtcgagtcgacctatatctctggacacgttccagcaactctagttttcccctgaagtatgtagttctgtcgacccgccgcgtgacgacgggtcgtttactacgtgtgcgagtagcgnttactagtgtattttggagttggtttatttcgtactaccgtagtagtcggacgggtcgtcccggcccggttacgggccggtaagggaacgttaccggtcgtaccgtaccgtctcccttacggtccctacccgg

SEQ ID NO: 142461 - DNA, 685 bp, Homo sapiens
  misc_feature: GYAE6OF02JL2H6.46.67.G01.1.454.CMB.1.raw
  modified_base (150)..(150): a, c, t, g, unknown or other
  misc_feature (150)..(150): n is a, c, g, or t
  modified_base (290)..(290): a, c, t, g, unknown or other
  misc_feature (290)..(290): n is a, c, g, or t
tcagactagcagtacacgaccggtgctcgatttagagtatacatattgggtttgggggacctcctgtgcaagaacatgaagcacctgtggtttgtcctcctgctggtggcaactcccacgatgggtcctcgtccctcggtggcaactgcnggagtcgggcccacgactggtggaggccgttcggacggaccctcgtccctccacctgcgctgtcctcgtcggtgacctccatcacgttagttggtttcttcgtaggggcgtcgggtccggcagcctccgagggagggcgnggactacgggggtataggagtgtctctcatagtaggtcggttcgtattacgtcgtcgtctctacagacgtacgacgtcgacctactatctctggacctacgtaccgacgacaactctacgtttaccgttacgacgtagtacgtagttcgtacggtcgtaccgtaccgtcgtacgaccgtacgggttacgtttacttacgttcgtggtcgaggacggacgtacgttattagttagttagttttaggtaggtttagtttacggtttacgtaccgtaaccgttacgtacgtaccgggtccgggtaccgtccggacccgggtccgggacggtaacgggtacgtacggttacggtccgtaccggttacccgttccggtaccgtaccctcccgtaacccgg

SEQ ID NO: 142462 - DNA, 727 bp, Homo sapiens
  misc_feature: GYAE6OF02FM194.46.67.G01.1.454.CMB.1.raw
  modified_base (135)..(135): a, c, t, g, unknown or other
  misc_feature (135)..(135): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtnccagatgtgacgatcgagctgacccagtctccatccctccctgtctgccaaccgtgggagacagtgtacaccntcacttcgaccgggcaaggtcgaactnttacgacacctaatttaagttggtatacaacgataacgaccgacgggaccgccccgtaagctacctatctagtgctgcatcctagtttgacgaaaggtcgggtacctagtcggaggttcgacgtggtactaggtaggtagtcggtaggtactaggtactttacacctactacacctactacgtaagtaacgttcgacggtaacaacgggtttaagaacgtttagttttaacaacctttaaaactttcgtttaaccgcgttaaacaaacgtaaacgttaactttaattaaacggtttcgggtttaaccgaacccgggttaaaacgggtaccctaaaccgggtaaaataaacccgttaaaaacgtaaaacccgttaggttacggtacggtacttacgtaaccgtaaacccgtatttacccgggttatttacccgttaccgttaaccggtttccccttaacccccgttacggtactttccgtaacggttaacccg

SEQ ID NO: 142463 - DNA, 577 bp, Homo sapiens
  misc_feature: GYAE6OF02FOUY7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctatctatgctgcattccagtttgacgtaaaggtcggggtacccagtcggtaggttcaggtggccaggtggatcgtgggacagtatttcacctctacaccatacagtaacttctagtccaaagttgaaagttattttacgacttaaccttatttactagtaccaaatagtaattactaatttcggtttccgacgaagggtactacgaactaactaaaattaaacgaacgttagtcggactcgacactattcctcgttacttactacttcccttacccgacctacttacctagtaacc

SEQ ID NO: 142464 - DNA, 807 bp, Homo sapiens
  misc_feature: GYAE6OF02H4WC7.46.67.G01.1.454.CMB.1.raw
  modified_base (245)..(245): a, c, t, g, unknown or other
  misc_feature (245)..(245): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagccctgtccctcacctgcgctgtctctggtcgcctcatcagtagtgtttctcgtgggctgggtcgcagcctccggagggacgggctggatacagttggagtgtctntcagtagtggaggttcctagttacagtcgtctctacagcgtcagtcaactatatctcgtgacgacgtcacgcaattctaacgttttcccgtagaacgtacgtagtacgttcgtagtcgaaccgccgtcgtacggacgtaacgggttcgttttaactacgttaggtcggtacgaacggtagtaacggtaccgtttaaataggttacggtttaagttttaggggtaacggtttacgggttttaacgtttacccggaaccgttacccggttaaggtaccgggttacgggggtaaccggggtaccccggtttaccccggggtaacccccgggtttacggggggtacccgaaaaccggggggttaacgttacccgggttaccggggttcccgtaaaccccggtttacccgtttacccgttaaccggtacccccgtacccggtaaaccccgggtaccggtaacccccggtacggtttacccccgggttcccctttaacccccggtccgggtaccccccgttaccccgttaacccccggttacggtaacccgtaccggttacccccggg

SEQ ID NO: 142465 - DNA, 766 bp, Homo sapiens
  misc_feature: GYAE6OF02GPCYF.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtggganacagtgcaccatcacttcgccgggacaaggtcggaactattcgaactaaccttaatttaaagttggtaatacaactagtagaccagggaccgacccctaagcctacctaatctatgactgacactccgtagtttacgacgtaaaaggtccggggtaccctaacgtcgggtaacggtttcgtaacgggttcggaccgtaagggttcggtaacgttcggtacggggtaacaacggtttacgttttacctaacgttccctaccgtaaccctatacgtaacgttaacgttacgtacggtacgtaaacggtagtaaacggtttacgttttacgtacctttaaacgtttaacgtttaacgtaacggttaaccttaaaacgtaagttaaacgtttaaaccgttaagtttaacggtttttaaccgggaaccgtaaaccggggtaacctaaaccgtaaaccgttaaaactaaaacgttaaaaccgtaacgttacggtacggtctacggtacctaaaccgtacgttaccgtcgttacgttacctactttcccgttacccgtacctaagttcctacgtaaccg

SEQ ID NO: 142466 - DNA, 591 bp, Homo sapiens
  misc_feature: GYAE6OF02JHQO4.46.67.G01.1.454.CMB.1.raw
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaccgtgggagacagtgcaccatcacgttgccgggacaacggtcggaactagttcgactaaccttaattttaaattggtaatcgaaactataacgaccaacgggaccgcccctaagcctacctaatctagtcgtactgtacactcctagtttcgacgaaggtcgggtccagtcgtagtnagtgcagtgatcgtaggacagtattacactcncacatacagtactcnactaagtagagttacttgactaacttntactntactaagattaactactagtttcgttaccggacgaacgtacaacgtaaccttaaacgtaaacttaacgtaacgtggtacgtctaacgcctaaccgtacttacgttacgtactttccgtaaccttccgttaccccgcttacgtaccttagtacg

SEQ ID NO: 142467 - DNA, 631 bp, Homo sapiens
  misc_feature: GYAE6OF02HWOR8.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgccgggcaagtcggaacnttgacactattaattgtatcaacatagacagggacgcccctaagctctaatctatgctgcatcctagtttgactaaaggtcgggtacccatcgaggttcaggtggctaggtggatcgtgggacagtatttcactcgtcacctatctaacgtatcgtagtaccgtaaggtagaagttattttacggacttaaactttaattacttacgttaacaaacgtaagtaaacttacgtaacgtttcggtttaccggacctaaacggggtacctaaccgtaactaacgttaaaaacgttaaaccggtaacttagggtacggtacgttcgaacccgtaacctacgttacgttaccgtttaccttacttacgttccctttaccccgacccgttaacttccgttagttaacccg

SEQ ID NO: 142468 - DNA, 682 bp, Homo sapiens
  misc_feature: GYAE6OF02G2M32.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacgttcggccgggactaacggtacggaaactagttcgaacctaccttaatttaaattggtaatcaacataacgaccgacgggaccgtacccctaagccttacctaatctatgctgactactcgtagtttgacgtaaggtcgggtcccagtcggtagtcaggtcgataggtggactcggtaggactagtacgttcaccttacctaccaccgtactaactaagtaactcgtacgaccgtaaacgtagtaagtttacgttttacgaacttaaaccgttttacttaacgttaccgttaactaaacgtaagttaaactttacgtaacgtttcggttaaccggacgtaaacggactaaaccgtaacttaaacgttaaaccgttaaacgtacgttacggtagacgtaccgactaaccggtactttcggtacttaccgtttacgtacctttcccgtaccccgtacttacgtccgtagttaaccg

SEQ ID NO: 142469 - DNA, 578 bp, Homo sapiens
  misc_feature: GYAE6OF02GYB4I.46.67.G01.1.454.CMB.1.raw
  modified_base (193)..(193): a, c, t, g, unknown or other
  misc_feature (193)..(193): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgactactatttaaatgtatcaanatagaccagggacgacccctaagctacctaatctatgctgcatcctagtttgactaaaggtcgggtaccctagtcggtaggttcagtcggcagtggatcgtagggacagtactttcactctacaccatacagtaatctgacgaacgtagaattatttgactaacttattactcgtacaactaagtaacttaactaacgttcggtttaccgaacgtaacggtactaacgtaactaaacgtaaaacttaaacgaattggtacgacttacgacctaacctattacgtcgttacttactacttccgtaccctactacgttctagtaac

SEQ ID NO: 142470 - DNA, 676 bp, Homo sapiens
  misc_feature: GYAE6OF02FYOI7.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtcctccatcctccctgtctgccaaccgtgggagacagtgtcaccatcacttggccgggacaaggtcggaactattcgactaaccttaatttaaagttggtatacaacatagaccaacgggacgacccctaagcctacctaatctatgactgacatcctagtttgacgtaaaggtcggggtacccagtcggtaggttacgaggtggacgtaggtggtaatcgtagggactagtactttacactctaccacgtatacgaagttaatctcgtaccgtaacgtagtaagttattttacgacttaaacttactttaacgttgtaacctaaacgtaataaacttaactaagtttacgttttaccgggaactaagggtaccaacggttaacctaaaacgtaaaagtttaaaccggtaaccgttaggtacggtaccttacggacctaacctaacgttccgttaacggttacctttaccgtacctttacccgttaccccgaccgttaacttccgtagttaacc

SEQ ID NO: 142471 - DNA, 668 bp, Homo sapiens
  misc_feature: GYAE6OF02G83NP.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatccagtagttggtttctcgtggggctggggtccggcagcctcccgagggacggggctggaatacagttaggaagtcgtctctcataggtggacggttcctattacgagttccgtctctacaagtcgtcgatcacctatactctcgtcggacacgtccagacaatctacgtttcccagaacgtatgtacgtttcgtgtcgacccgcccgtctacggacgtacgggttacgtttacgttacgtggttcgtacgacggtacgaccggtattagttacgttaggtttagtttttagggtagttttacggtttacgtttaccggtaacctaccgttaagtaccgttaccggggaccggggttccctcccgggtaccccggtaggggacccgaagggtaacgttaccgtcgggttaccgttaccgttacccgttccgttaccgtcccctaacccgg

SEQ ID NO: 142472 - DNA, 684 bp, Homo sapiens
  misc_feature: GYAE6OF02FIR7M.46.67.G01.1.454.CMB.1.raw
  modified_base (137)..(137): a, c, t, g, unknown or other
  misc_feature (137)..(137): n is a, c, g, or t
  modified_base (168)..(168): a, c, t, g, unknown or other
  misc_feature (168)..(168): n is a, c, g, or t
tcagactagcagtacacgaccggtgctcgatttagagtatacatattgggtttgggagtctcggtcaggacacagcatggacatgaggtcccgctcagctcctggggctcctgctactctggctccgaggtgccagntgtgacatcgagctgacccagtctccatccncctgtctgcaaccgtggagacagtgtcaccatccacgttgccggtcaagtcggaacattggacaccgttatttaaacgttggtaactcaacatacgaccaagggacgcccctaagctcctaagtctaatcgctgcagtccctagttcgcgtaaagtcggggtacctagttaccggaggtttaccaggtcggctacggtgggactcgttaggggactacggtactttacgactttcgtacgtaacccgtagttaccgaacgttacttacggtacgtacgaacggttagaacgttacgtttacgtaacctaaagttacttacgtacggttacaacgtaacgtaacttaacgtaagttcgttttaccggaccgtaacggtacctaacggtacttaaacgtaaacgttaaccgaaacgttcgtaacggtaccgtagtaccgttaaccacgttaccgtcgttacccgttacgtaacgtttcccttaacccggtccgttaacgtttaccgttgttaacccgg

SEQ ID NO: 142473 - DNA, 705 bp, Homo sapiens
  misc_feature: GYAE6OF02FYELY.46.67.G01.1.454.CMB.1.raw
  modified_base (248)..(248): a, c, t, g, unknown or other
  misc_feature (248)..(248): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgagccttggagaccctgtccctcacctgcgctgtctctgtgcctccatcagtagtggtttctcgtggggcttgggtccgcngtcctccgagggagggctggaatacattggaagtgtctcgtctagttggtaggacgtttccttaattactacgttccgtccttacgtctaaagngttcggtagtacctacctatacttcctcgtgggtaaccaccgtacctagactaacgttcctaacgtttttcccgaggtaaacgtgtttacgtaacgtttccgttaggtaaccgtaaccccggtcggtacccttacgggtaaaccgtacccggggttacctttttaacgtaacccttgggttacgtaccggaacggtagggtacccgtagtttacgttaacgtttggtaaacgtttttgggtaacgtttgggttttaacttcgtaacctaccgttaggacgtacggcgggttacctacccgggtccgcggggactagggtaacttacgtcggtccgtaccgttcgtaccttaccgctaacccgg

SEQ ID NO: 142474 - DNA, 833 bp, Homo sapiens
  misc_feature: GYAE6OF02HPYU9.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagactggtgacatcgagctcgacccagtctccatcctccctgtctgaccaaccgtggganacagtgtacaccatcagttccggccggacaaggtcggaaacagtttcggaacctaaccgttaatttttaaaacgtcggttaacttacgaactaagtaacgaaccgtaacgggaccggacccctaaacggtacctacctaacttactaactcgctcgactactaccgtattacggtacgaaacggttcgggtaccctaagttccgggtaagttaccgtaggtacggacgtacgggtagtacggttacggtacggggaactaacggttacgtttacctaccgttacctttaaccgtcccgtaaagtttcccggtaaaagtttaacttacccggttaacggtaacccgttaacggtaacgttaaagtttaacgttttaacgttaaccgaacgtttttaaccttaacttaacgttaaaccgtaacgttaagttaaactttaagtaaaccgtttttggtttaacccgggaaacgtaacggtaacccgaaaccgttaaacgtaaaacgttaaaaacccgttaaagtaaccgtttaagggaccggttaccgttaacgtaacccgtaaccgtaactttccgtaacgtttaccgttaccttaccgtttacccttaccccacgtttaacctcgttaacgtaaccg

SEQ ID NO: 142475 - DNA, 693 bp, Homo sapiens
  misc_feature: GYAE6OF02JX06Q.46.67.G01.1.454.CMB.1.raw
tcagactagcagtacacgaccggtgctcgatttagagtatacatattgggtttgggggagtctcggtcaggacacagcatggacatgagggtccccgctcagctccgtggggctcctgctactctggctccggaggtgccagatgtgacatcgagctgacccagtctccatccctcctgtctgcaaccggtgggagacagtgtcaccatcacttggccgggacaaggtccggaacattcgacctaccttaattttaaagtggtatacaacataagaccgagggaccggcccctaagcctacctaatctaatcgctgctactccgtagtttcgacgtaaaggtcggggtacccagttcggtaggttccaggtggacgtaggtggtatcgtagggacagtactttacacgtcctacacctatacacgttaactctagaccgtaacggttagaagttacttttacgacctaactttacttacttcgtacctaaactaacgtaactttaactacgttttacggtttaccggtaaccgtaacgggtaaccgtaaaccgtaaccttaaaccgtaaaacgttaaaccgtaaccggttagttaccggtaccgtacgtacctaaccgtacttacgtttaccgttaccgttaccttaacgtttccccgttacccgtacccgttacttaccgtacgttaacccg

SEQ ID NO: 142476 - DNA, 982 bp, Homo sapiens
  misc_feature: GYAE6OF02HW5MH.46.67.G01.1.454.CMB.1.raw
  modified_base (180)..(180): a, c, t, g, unknown or other
  misc_feature (180)..(180): n is a, c, g, or t
tcagactagcagtacacgaccggtgctcgatttagagtatacatattgggtttgtcctcctgctggtggcagctcccagatgggtcctgtccctggtgacaactgcaggagtccgggcccacgactgggtgacggtccttcggagacccctgtcccctcacctgcgctgtctcgtggtcncctcatcagtagtcgtttctcgtgggctgggtccgcagcctaccggagggacgggctaggaatacgtagttaggaagttgtacctacgtactagtaggtggtacgttacctactacgtacgttccgtcctctacgtaagtacggtacgtaacgtaccaacctactacttaccgtacgtacggaaccgtaccgtaccgtacgactaacttcgttacgtttaccgtacgtaacgtacgttacgtacgttcgttacggtaccgaccggtccgtacgtaccggtacggtaaccgggtttacttttaacggggggggggggggggggtttacttacgggttacggtacggtacggtaacgggtaccggttacgtttaaacgtttaacgtttaaggtttaacggtttttacgggttaacggttttacggtttttaaccggttttaacccgttaaacccgttaaacccgttaacggttaccgggttacccggggtacccgggggttacccgggttaccccgggttaacccccggggttacccgggggtaacccggggtaaaccggggttaaaccgggttaaccgggttaccgggttaacccggtaacccggtttaacccgtttacccgtttaacccgttaccccgttaaccccggtaaccccgggtaaaccccgggtacccccggttaacccgggtttaccccggtttaccccccggtttaccccccggttaccccggttaacccccggttaacccccccgttaaccccggtttaaaccccggtaacccggtaacccgtaacccccggg

SEQ ID NO: 142477 - DNA, 662 bp, Homo sapiens
  misc_feature: GYAE6OF02JQO43.46.67.G01.1.454.CMB.1.raw
  modified_base (219)..(219): a, c, t, g, unknown or other
  misc_feature (219)..(219): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggacacagtgtcaccatcacttgccggganagtcggaacattgaccacttatttaaatcggtatcaacatagaccaggaccggcccctaagcctacctaanctanacgtctcgcactccctagtttcgacgtaaaggtcggggtaccctagttccgtaggttcctaaggttggaccgtagggtggtacttccgggagggtacaggtactttcgtaccttctaccgaccctatactaaggttaactctacggaactaaccggtagtaaacgttagtttacgactttaaacgttacttaacgttccgttaacaaaccgttaagttaaacttaacgtaagttttcggttttaaccggaccgtaaacgggtacctaacgtaaccgttaaataaaacgtaaacgtaacgtgtacggtactacgacgtacctaggttactcggttactagtaccttacgtaccctcacttcgtactacg

SEQ ID NO: 142478 - DNA, 777 bp, Homo sapiens
  misc_feature: GYAE6OF02HVWRG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtgggacacagtgtccaccattccaactttcggacccgggactaacggtcggaaacctagtttagaacctaaccgttaaattttaaaagtttcggtaattaccaaaccgtaattaacgaacccgtagggggaacccgtaccccctaaaggcccttaccgtaaattcctaacgttcgcctacggacctaacgttccgtaagttttacgaaccgtaaagggttcggggtaccctagtcggtaggtttcaaggtggacagttcggatcggtagggaactagttacttcaactccgtacaacctataccgtaagttaactcgtagacgtaacgtagtaaacgttagtttacgacttaactttattaacgttcggttaacctaaacgtaagttaaactttacgttaacgtttacggttttaccggaaccgtaaggtaaccaacgttaaccttaacgtaaaacgtttaaaccggtaacgttacggtacgtaccgtaacggtaccctaacgttaccttaccggtttaacgttaccctttactaacccgtttccccgttaaccccgttaccgttacctttaccggtacgttaaacccg

SEQ ID NO: 142479 - DNA, 747 bp, Homo sapiens
  misc_feature: GYAE6OF02FFAGX.46.67.G01.1.454.CMB.1.raw
  modified_base (571)..(571): a, c, t, g, unknown or other
  misc_feature (571)..(571): n is a, c, g, or t
tcagactagcagtacacgaccggtgctcgatttagagtatacatattgggtttggggagtctcggtcaggacacagcatggacatgacgggtcccgctcagctcctggggctcctgctactctggctccgaggtgccagatgtcgacatcgagctacgacccagtcctacctactccctccctgtctacgaccgtaaccggtgggacacgtagtcgtaccacctactaccgtacgttcgggaccgggtaacctaacggtaccggaacttacgttacgaacctaacctttaagttttaaacgtaggttaacaccaaactagtaccggaccggaacgggtaccgacccctaagtccttactaacgtctagttcgctacactacttaccgtagttacgaacggtaacggtccggtactaggtaccggtagttacgacgggttacgacgttaggtacggtacgtacgggtacggacttaacggttaccttacgtacccttaccgtaaccgtactacgtacgaacttacgtacgtacgaacgtacgtagttaacgttcttacgtactagtacttanactacgtaatacgtaacttactacgttcggtacgaacggtacgaacctaacgttaaacctaaacgtaaaccttacggacgtacgggtacctacacccggtacttaaacgtccgtttaccttaccttccgtttaactaccccgtttaccgtacccgtataccggtactacggttaac

SEQ ID NO: 142480 - DNA, 701 bp, Homo sapiens
  misc_feature: GYAE6OF02IXAKY.46.67.G01.1.454.CMB.1.raw
  modified_base (191)..(191): a, c, t, g, unknown or other
  misc_feature (191)..(191): n is a, c, g, or t
  modified_base (481)..(481): a, c, t, g, unknown or other
  misc_feature (481)..(481): n is a, c, g, or t
  modified_base (637)..(637): a, c, t, g, unknown or other
  misc_feature (637)..(637): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccggtggganacagtgtaccaccatctacgttcggccgggacaaggtacggaactagttacgaacctaaccttaattttaaaacgttggtaactaccgaaactagtaacggaaccgaacggggaccggtaccccctaaaggccttaaccgtaatcttaagtcgctagctactccgtagtttcgaacgtaaacgggtccgggtaccctagtcggtacggttcctaggtggcgtaggtacgtcgttcggtacgggaacgtagttactttcgaccttcgtaccaactacgtactaagttaccncgtacgaacgtaacgtagtaattacgttacgtaacttaacctttagttaaccgttactaactaaacgtaagttaacctttaacgtaagtttccggtttacgaccgtaacggtaactaaccgtactaaaacttaaacgtaaacgtagtacgcgttanaccgtacaaccgttctacttccgtaacttccctacttcccctaccgtactacgtcgtacgtacg

SEQ ID NO: 142481 - DNA, 610 bp, Homo sapiens
  misc_feature: GYAE6OF02GMLFJ.46.67.G01.1.454.CMB.1.raw
  modified_base (371)..(371): a, c, t, g, unknown or other
  misc_feature (371)..(371): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatccacttggccgggacaacggtccggaactattcgactaccttaattttaaaagttggtaatacgaaactataacgaccgagggaccgccccgtaagctacctaatctatgctgactatcctagtttacgacaaaggtcgggtacccagtcgaggttcgagtcggtnagtgagtcgtgggacgagtacgttactactctacactactacgtagtactacgtgtacgaagtacgtaagtactttagtacgtaacttattacgttagtactaacgaataacttactaagttcgtttacgacgtaacggacacgtaacctaactaaacgttaaacgtaacgtagtagtactacgtacacctatccgtattccgttactacttccgttaccctacctatccgtagtaacg

SEQ ID NO: 142482 - DNA, 554 bp, Homo sapiens
  misc_feature: GYAE6OF02F5WHW.46.67.G01.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccgggnaaggtcgaacattgacacctatttaaatggtatcaacatagaccagggacgcccctaagctacctaatctatgctgcactccagtttgacaaaggtgggtcccatcgtaggttcagtgcagtgatcgnggacagtnttcactctcactatcagtactctgactaacgtgtaagtatttgactaacttattactagtacaactagtaacttactaattcgtttacgaccgtaagggacacgtaactaactaaacttaaacgtaacgttagtacgtactacgaccgtactacttacttagttaccttactacttcccgttacccgacctacttctagtac

SEQ ID NO: 142483 - DNA, 660 bp, Homo sapiens
  misc_feature: GYAE6OF02HXTXS.46.67.G01.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacngtgtcaccattccacttggccggnaagtcggaacattgacaccttatttaaattggtatcaanatagaccgaggaccgccctaagctacctaatctaatgctcgctatccgtagtttcgacgtaaaggtcgggtacccagtcgtagttcgagtggacgtgtaggatcggtaggactagtacgtttcactctccaaccgtactcgtaagttaactcgtacgtacgtaaggtagtaaagttnttttacgaactttaaactttacttaaccgtagtaccaaacgttaagtaaacgtttactaaacggttttcggtttaacccggacggtaacggtacctaaaccgaaccttaaaacgttaaaacgttaaaccgtaagttcggtacggtactaccgaaccgaccttactttaccgtcgttaccttacgtaccttcccgttacccgacccttagttccgttattaaccg

SEQ ID NO: 142484 - DNA, 635 bp, Homo sapiens
  misc_feature: GYAE6OF02IW7TO.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttctggggctgggtccggcagctcccgagggaggggctggaatacattggaagtgtctctcatagtggaggttcctattacagtccgtctctacaagtgtcgagtcacctatactctctgacacgtccagctaatctagtttcccagaatagtgtagttctgtcgaccgccgtctcggacgacgggtacgttttactacgttggtcgacggtagacggtacggtactttaagttatgttagtttttggagtttggttatttccgtaacgtacctaagtacgtaccgggtaccgggggtccttacccgggaccccggttacgggggtacccgtaagggtaaccgttaccggtacgggttcccgtaacccggttccgttacccgtttaccggcccgttaacccccgg

SEQ ID NO: 142485 - DNA, 595 bp, Homo sapiens
  misc_feature: GYAE6OF02G79T8.46.67.G01.1.454.CMB.1.raw
  modified_base (192)..(192): a, c, t, g, unknown or other
  misc_feature (192)..(192): n is a, c, g, or t
  modified_base (584)..(584): a, c, t, g, unknown or other
  misc_feature (584)..(584): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtggganacagtgtcacatcacttggccgggcaagtcggaacagttgactaccttatttaaattggtatcaactatacgaccgagggaccggccctaagcctctaatctatgctgctactccaggtttcgacgtaaaggtcgggtcccagtcgtagggttcaggtggcgtaggtggtatcgtagggactagtactttcacttcacaccctattacgaagttaatccgtagacgtaaacggttggaacgtttaattttacgttaaactttagttacctaggttactaaacgtataacttacaagtttcgttacgacgaagggtacaagtaataacgtaaataacgaacgtgtagtctcgtacacctattcgtgttacctgttactccgttacccatactntacgtatacgg

SEQ ID NO: 142486 - DNA, 641 bp, Homo sapiens
  misc_feature: GYAE6OF02G400N.46.67.G01.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattggggtttggggagtctcggtcaggacacagcatggacatgagggtcccgctcagctcctggggctcctgctactctggctcgaggtgccagatgtgacatcgagctgacccagtctccatcctccctgtctgcaaccggtgggacgacagtgtcaccatcacttgccgggnaaggtcgaactntgacacttatttaaatggtatcaactatacgacgagggacgcccctaagctacctaatctatcgctgctactccgtagtttcgacgtaaggtccggggtccctaagtcggtaacggttcgtaacggtggacgagtggtacgttacggtaggggaactaaggttactttaccgtacttacctacaaccgtatactaagttaactctagacgtaacgttagtaaacgttagtttacgactaaactttacgttattacgttaactaacgaataaacttaactaactttcggtttacgaaccgtaaggaaccctaaggaacttaaacgtaaactaaacgtaacgtgggttacgacttacgaccgtaactatcgttagttacctatccgttacctccgtaacttcgtacgtctacg

SEQ ID NO: 142487 - DNA, 1018 bp, Homo sapiens
  misc_feature: GYAE6OF02JD8V2.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcgcccgtccatccgaggttagttcggttttccttcgtcggggtccgttcgggggtcccgcgtacgtcctacccggagggggtaacgggggcttacgggaaacttaccgtaggttacgggaaacgttcggttaccgtaccgtacgtaacgttacgggttacgggggttaaccggttttacccttaacggtttaaccggtaaccgggtttccccggttaccttacccgttaccggtaaaaacgggttacgggttaccggtaaccgttaccccgaaaccgttaagtttaaccgttcccgttaccggttaaccgggtaacccgttaaccccggttacccgtaagggtaacccttaaacgttacccggttttaacccgtttttttacccccgaagggtaaaacggttacgtttacgggtttaaaccggttttccgttacgggtacccgggtacccccggtcccggtaccggttaccggtaaaccgggtaacccggggttttaccggttttaaacttaccgggtttcgggttaaccggaccggttaaacgggttaccgggtaaccggttaacggtttaacgtttacggtttaacgggtttttaacgggtttttaacggggtacggtttttaacggtttttacccgtttaccggtaaaccccgtaaccggtttaagtacccgggtttaacggggtacccggggttacccgtacccggggtaaccccgggttcggggtaaccggaacgggtttacttacccgggttacggttcccgtaccgttaccgttacccgtccggtacccttaaccccggg

SEQ ID NO: 142488 - DNA, 640 bp, Homo sapiens
  misc_feature: GYAE6OF02IU62O.46.67.G01.1.454.CMB.1.raw
  modified_base (351)..(351): a, c, t, g, unknown or other
  misc_feature (351)..(351): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgactacctatttaaatggtatcaacatagaccgagggacggacccctaagctacctaatactatgctgcactcctagtttgacgtaagtcggggtaccctagtcggtaggttcgagtcggnaggtggtatcgtgggactagtatttccactctacacctacgtactagtaacttcgtacggactaacggtagaagttacgtttagaacctaacttttaattacttacgtactaaaccgtagttaaactttaccttaaagtttcgtttaccgggtaaccgtaagggtaacctaacggtaaccttaaactaaacgttaaactaacgttgtacggactacggtacctccgtaaactcgtttacgtaccgtttacgtactttccccgttaccgtacctaaccttctacgtaacg

SEQ ID NO: 142489 - DNA, 719 bp, Homo sapiens
  misc_feature: GYAE6OF02JXF6M.46.67.G01.1.454.CMB.1.raw
  modified_base (680)..(680): a, c, t, g, unknown or other
  misc_feature (680)..(680): n is a, c, g, or t
tcagactagcagtacacgaccggtgctcgatttagagtatacatattgggtttgggggaccgtcctgtgcaagaacatgaagcacctgtggttgtcctcctgctggtggcagctcccagatgggtcctgtccctggtgcaacctgcaggagtcgggcccacgactggtcgaggccttcggagaccctgtccctcacctgcgctgtctctggtgcctccattccaggtagttcggttttccttcgtgggggcttcgggggttcccggtcgaagtccgtcccgacggggaacgggggtcgtacgggaataaccgtatttacggggaaagttgtccgttactccgtaataggttgggtacggtttcctaagtttaccaggttcccgttcgtcttaccgaagtagtccgtagttaccacccgtattaactcctcgttaggacctaaccggtccagtccaagttactacggtttttcccagggtaacactttaggaccgtttcgtagttcggtaccgtccgtctcggtactaccgggttgtttacgttactggtcggtacaggacgtcggtacctagttaccgttgtaattttgggtacgtttagggtttactttacgtacgtaccgtagtactcgggaccgggttctacccggtaccggttcgggacctagggaactttccggnggtttaccgaccgttcgtaccttacggtcctaaccccgg

SEQ ID NO: 142490 - DNA, 662 bp, Homo sapiens
  misc_feature: GYAE6OF02F12GT.46.67.G01.1.454.CMB.1.raw
  modified_base (151)..(151): a, c, t, g, unknown or other
  misc_feature (151)..(151): n is a, c, g, or t
  modified_base (199)..(199): a, c, t, g, unknown or other
  misc_feature (199)..(199): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgaaaaacntcgagctgacccagtcctcactcctcctgtctgaccaaccggtggganacagtgtaccaccatctacgttcggccggactaaggtccggaactattacgaacctaacctttaattttaaagttggtatacaaactagtacgaccgaggggacccgacccctaagctacctaatctatgctgctatccgtagttgacgtaaaggtcgggtaccctagtcggtaggttcaggtggactaggtggatcgagggacagtacttacactctaccactactacgtaagtactntcgacgtaaacggtgtaaagttacgttttacgaaccttaaacttagttactacgtaactaactaagtaaattaactaaggtttcggtttacggtaccgaaagggtaacctaaccgtaacttaaacgtaaaattaaacgtacgtaggtacggtacctagacctaaccgtacttcgttacgttcttaccgtaccttacccgttacccgactacgttcctagtaacg

SEQ ID NO: 142491 - DNA, 1036 bp, Homo sapiens
  misc_feature: GYAE6OF02F0CR4.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgacggccttcggacgacccctgtccctcacctgcgctgtctcgtggtcgcctccatcagttagttcggtttcttcgtggggcttcggggtccggcacgcctacccggaagggggaacgggctaggaactacgagttgggaagttcgtctctacagttaggtggtacggttacctagttacgacgttccgttctctacgaagtacgtcgacgtccaacctattactccgtacgtacggaccgtaccgtaccacgtacctaacgttccgtttaaccggttttaccccgtaaggtaaacggtacgttacggttacggttttccgtacgggttacccggtaccccgggtcccggtaccgttaaccgggtaacccgggtaacccgggggttttaaccgttttttaaccgtttaccggttcgggtttacgggaacgggtaacgggtaaacgggtaaccgggttaaccgtttaacggttttaacggttttacggtttttaagggttttttaacggggtttaacgggttttaacgggtttttaaccggtttttaacccggtttaaaccccggtttaaaccccggtttaaaccgggttaaccggggttaacccgggggtacccgggggttacccgggttaccccgggtaccccggggttacccgggggtaacccgggtaaccggggttaaccggttaccgggttaccggttacccggttacccggtttacccgtttacccgttcccggttaaaaaaaaaaaaaaccccgttcccccggtaaccccggtaacccgggttaaccccggttacccgggttaccccggtttacccccggtttacccccggttaccccggttacccccgttaccccccgttacccccggttaacccggtaaccccggtaacccgtaccccgg

SEQ ID NO: 142492 - DNA, 767 bp, Homo sapiens
  misc_feature: GYAE6OF02H3SQC.46.67.G01.1.454.CMB.1.raw
  modified_base (513)..(513): a, c, t, g, unknown or other
  misc_feature (513)..(513): n is a, c, g, or t
  modified_base (684)..(684): a, c, t, g, unknown or other
  misc_feature (684)..(684): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtggaggtcctttcgggagaccccttgtcccctcacccgtgcgctgttcctcgtggtcgcctaccatcaggttagttggttttccttcggtggggtcgttgggggccggcacgtcccgtacccggaaggggacgggtcttaggaaatacaggtttagggaacgttgtccttctacagttaggttaggtacggtttccttaagttaacgtccgttccgtactctacgaaaggtcgttacgacgttccaacctattactccttcgcggtaacctaccggtaccagtactaactcgtttacgtttaccctaggaactagttgtaccgtttacgcggtacggaccccgtaccgcgtacgtaccgggtacggtttaccttttactttacggngttacggcgaaggacggtacgtacgtttagttagttagtttagttttaggtggtttacggtttactttaccgaaccgttaacccgtagtacgttccggggacgggtccgtaccgtccccggggtagggaccgtaagggtacgtcgtacggttccaccgttccgtcttaccnccgtaccacggtaacccggccctacggtcccgttcccctccccgtacgtcccctaccccgtcctacccggagaccgtacccgg

SEQ ID NO: 142493 - DNA, 691 bp, Homo sapiens
  misc_feature: GYAE6OF02GXK7C.46.67.G01.1.454.CMB.1.raw
  modified_base (254)..(254): a, c, t, g, unknown or other
  misc_feature (254)..(254): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattggggtttgggggagtctcggtcaggacacagcatggacatgagggtccccgctcagctcctggggcttctgctactctggctccgaggtgccagatgtgacatcgagctgacccagtctccatcctccctgtctgcaaccgtgggagacagtgtcaccatcacgttggccgggacaagcggaacattgacactattaatgtatcaanatagaccgagggaccgacccctaagcctacgtaactctatcgactgctactcctagttcgacgaacggtcgggtacccagtcggtagttcgnggtggcgaggtgatcggtagggactagtactttcgactctacactatacgtaagtaactcgtagaacgtaacggttagtaagttacttttacggaacctttaacttaacgttaccgtaagtacctaaaacgtaagttaactttaacgtaagtttccggtttaccggaaccgtaacggtactaacggtaaacctaaacgttaaaacgtttaaaccggaattcgggtacggtacctacggtaacccgtaacgttaaccgtttacgttaccgttttaccctttaacgtaacccggtttttccccgttaaccccgtaacctaaccggttttacccgaacggtttaaccc

SEQ ID NO: 142494 - DNA, 564 bp, Homo sapiens
  misc_feature: GYAE6OF02JRWI6.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatcacttggccggganaagtcggaacattgaccacttatttaaatggtatcaacataacgacctagggaccgacccctaagctacctaagtctaatgctgcactcctagtttcgactaaaggttcgggtcccatcggtaggttcaggtcgcaggtgatcgtagggactagtattcgactctacacatacagtaactctgactaacgtagaagttatttcgaactaactttatacgttagtacaactagtaattactagtttacgtttgaacctaggacaacgtactaactaaataacgagtagtagtacagtaccgactagtctagttaccttacactttcctaccgctactcgtataacg

SEQ ID NO: 142495 - DNA, 738 bp, Homo sapiens
  misc_feature: GYAE6OF02FYXFX.46.67.G01.1.454.CMB.1.raw
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
  modified_base (416)..(416): a, c, t, g, unknown or other
  misc_feature (416)..(416): n is a, c, g, or t
tcagactagcagtacacgaccggtgctcgatttagagtatacatattgggtttgggggacctcctgtgcagaacatgaagcacctgtggtttgtcctcctgctggtggcagctcccagatgggtcctgtccctggtgcaactgcaggagtcgggcccacgactggtgaggccttcgggagaccctgtccctcacctgcgctgtctctggtcncctcatcagtagttggtttctcgnggggtcttggggccgactgcctccgagggagggctaggaatacgagtttggaagttgtctactcgataggtggacgttcctattacgacgtccgtattcacgaagcgtcgattccaaccattactccgtactcgggaactcgtaccagtacaaactctaacgttttcccaggtaaacgtntggacttttctaggtacgaccccggccggtacttacgaaccgtacgggttacggtttaacttcgttcggttaggaccggttagaccggtacgggttaccttaagtttaacttagggttaacgttttttcggggaaaggttttttcgggtttaactttttcccgggaaaccgtttaccccgttaagggttaaccgggtccggggttaacgggggggtcccttaacccgggttcccccgggtgggggtaaccccggtaagggttaaacgttacggttcggtttacccgaccgtttacccgttacctacggttcccctaacccgg

SEQ ID NO: 142496 - DNA, 756 bp, Homo sapiens
  misc_feature: GYAE6OF02HB354.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtcgggcccacgactgggtgacggccttcggacgaccctgtcccctcacctgccgctgtctcgtggtcncctcatcaggttagttcggtttctcgtggggcttcggggtccgcacgcctacccggagggggtaacggggctagggaacttacgagttagggaagttgttcctcgtacgtagttaggtgggtacggttccttaagttaccgacggttcccgtctacttacgaaaggtcggttacgacgttccaaccgtattacgtctacgtacggaacctacgtccaagactaacgttccttacggttttcctaggtaactagttggttacgttctcggtacgaccccgcgtacgtcggtaaccgcgggtttactttacgtacgtggttacgaccggtagacgggtacgtctttaagtttagttggtttagtttttgggtaagtttacggttttacgttaccgtaacccgtaaccgttaagggtacgtaccgggggtaccggggttctaccccgggtaacccgggttcggggaaccggtaagggtaaccgttaccgggtcgtacccgttacccgttacccgttacccgttaccggtacccctaccgg

SEQ ID NO: 142497 - DNA, 691 bp, Homo sapiens
  misc_feature: GYAE6OF02H7JGK.46.67.G01.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttgggggagtctcggtcaggacacagcatggacatgagggtccccgctcagctcctggggctcctgctactctggctcgaggtgccagatgtgacatcgagctgacccagtctccatcctcctgtctgcaacgtggganacagtgcaccatcacgttggccgganaagtcgaacattgactacttaatttaaagttggtatacaanatagaccgagggaccgaccctaagcctacctaatctatgctgctatcctagtttcgacgtaacggtcgggtaccagtacggtaaggttcgaaggttcggactagggtgatcggtagggatacgtatttcacgtcctacgacctagtacaagttaactcgtacgacgtaacgtagtaagtttagtttacgtaacttaactttaattacgttacgtaactaaacgtaagttaaacttaacgtaacgttttcgggttttaaccggaaaccggtaacggtaacctaaaccgtaaaccgttaaaacgtaaaaccgttaaaacgtaaccgttacggtaggtaccgtacggtaaccaaccgttaacgttaccgtaccgtttaccgttaaccttacggtttaccccgttacccgttaccgttacgtttacgtacgttaaccg

SEQ ID NO: 142498 - DNA, 641 bp, Homo sapiens
  misc_feature: GYAE6OF02GK7IM.46.67.G01.1.454.CMB.1.raw
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctgggaatacatttgggaagtgtctctcagtagtggaggttcctattacagtccgtctctcaagagtcgagtcaccatatctctggacacgtccagcaatcagttttcccngaacgatgagttctggtgacccgcgctgacacgggtctttattcgtgtgcgagagcggctattatgtagttttggagttggttagtttcgactacccgtagtacgtcggacggggtcgtccggtaccccggtggggacccgaaggggtaacgtaccgttacgggtacctacccggttccttcccgttacgtccctacccgaacccggtaaccgggtacccctacgttcccggttaccccgtttccccccggtcggtccccgtacccccgttccccgtacccgtaacggccgtaaccccgg

SEQ ID NO: 142499 - DNA, 584 bp, Homo sapiens
  misc_feature: GYAE6OF02GTSMY.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggnaagtcggaacattgactacctatttaaattgtatcaacatagaccagggaccgcccctaagcctacctaatctatgctgcatccagtttgactaaaggtcgggtcccagtcggtaggttcagtggcgagtggatcgtgggactaggtactttacacttctacacctatacaagttaactctagaccaagtaggtaagtattttgacttaacttaattcgtatacaaacgtagtaattaactaattcgtttaccggacgtaagggacaacgtaacttaactaaaacttaaaccgtaatagtgtactcgacctaacctattccgttacgttcttctacttcccgttacccgacctacttctacgtaacg

SEQ ID NO: 142500 - DNA, 778 bp, Homo sapiens
  misc_feature: GYAE6OF02IW83U.46.67.G01.1.454.CMB.1.raw
  modified_base (174)..(174): a, c, t, g, unknown or other
  misc_feature (174)..(174): n is a, c, g, or t
  modified_base (213)..(213): a, c, t, g, unknown or other
  misc_feature (213)..(213): n is a, c, g, or t
  modified_base (307)..(307): a, c, t, g, unknown or other
  misc_feature (307)..(307): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcncctcatcagtagttggtttctcgtggggctgggtccganacgcctccggaggggacgggctaggaatacgagttcggaagttgtctctacagtaggtggtacggttcctagttacagttccgtctctacaagngtcgagtccacagttactctacgtcggaactaccggtcctagacgtaaacttccgttacgttttcccaggaaacgtactaggttacgttacgttcggtaccggacccgtccggtctacgaaccgtcgggtttacttttaacgttacgtcggtacggacggtacgtaacggtcggttacttaagttacggttaggtttagttttcgggtaggtttacggttttacgtttaaccggtacctaccgttaaggtacggtacgggggtaccgggtccggttaccggtaacccggttggggaccgtaacgggtaacctacgggtcgttaccgtaccggttaccgttaccgttaccggtcccgtaacccgtaaccggtaacccggtcccgtaaccggtttcccggtaccccctttcccccggtaccggtaccccctaccccggttaccccgacccggtaaaccgtcccgttaaccccg

SEQ ID NO: 142501 - DNA, 617 bp, Homo sapiens
  misc_feature: GYAE6OF02FSVHR.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggacaagtcgaacattgacacctatttaaattgtatcaacatagaccagggacgcccctaagctcctaatctatgctgcatcctagtttcgactaaaggttcggggtccccagtcggtaggtttcaggtggcgtaggtggtatcgtagggacaggtactttcacttcgttccacctatccgtaagtaacttctcgacgtaacgtagtaagtacttttagactaacttattacttagtactaaactagtaacttaactaagttacgttttaccggaaccgtagggtaactacgtaacttaaacgtaaaacgtttaaacgtaacgtagtacgtacgtacgtacgtaacctattacgtacgtttacgttactactacccttacccgtacctacttacgtgtaacg

SEQ ID NO: 142502 - DNA, 677 bp, Homo sapiens
  misc_feature: GYAE6OF02H82U8.46.67.G01.1.454.CMB.1.raw
  modified_base (195)..(195): a, c, t, g, unknown or other
  misc_feature (195)..(195): n is a, c, g, or t
  modified_base (646)..(646): a, c, t, g, unknown or other
  misc_feature (646)..(646): n is a, c, g, or t
tcagactagcagtacacgaccggtgctcgatttagagtatacatattgggtttgggggagtctcggtcaggacacagcatggacatgagggtcccccgctcagctcctggggctcctgctactctggctccgaggtgccagatgtgacatcgagctgacccagtctccatcctccctgtctgccaaccgtggganacagtcgtcacctatcacgttggccgggcaaggtcggaactattcgaactaccttaatttaaattggtactacaacataagaccgacgggaccggaccccgtaagtcgtacctatactatacgctgactataccgtagtttagacgaaaggtcgggtcctatcggtaggtcaggtggacgagtcggatcgtagggaacctagtaatttcgtaacttccgtacgaacctactacgtagttaactcgtacgtaccgtaaacgttagtaaagttacgtttacgaccgttaactttaagttacctacgtactaacgtaagttaaactacgttaacgtttacggtttaccggaaccgaacgggtactaaccggtaaacttaaaccgtaaaacttaaaccggtaagtacgttacgggacgttccaacgttaccaacttccgtagtttaccttacctnttacccgttcccacgtactacgtagttaacc

SEQ ID NO: 142503 - DNA, 593 bp, Homo sapiens
  misc_feature: GYAE6OF02I0U2U.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactaatttaatgtatcaacatagaccagggacgcccctaagctcctaatctatgctgcatccagtttgacaaagtcggggtcccatcggtaggttcaggtggacgaggtggatcgtagggacagtattcactctccaacactacagtaatcgtagacaacgtagaagtatttgactaacttattacttcgtacaacgtaagtaactttactaactttgttttaccggacctaaagggtacctaaccggtaactaaacctaaaagtttaaaaccgtaacgttagtaggtacctagtacctaaccgtattcgtacgttaccttcgtacttacccttaccccggacctacgtcttagtaaccg

SEQ ID NO: 142504 - DNA, 733 bp, Homo sapiens
  misc_feature: GYAE6OF02IZ79U.46.67.G01.1.454.CMB.1.raw
  modified_base (206)..(206): a, c, t, g, unknown or other
  misc_feature (206)..(206): n is a, c, g, or t
  modified_base (303)..(303): a, c, t, g, unknown or other
  misc_feature (303)..(303): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggagtcgggcccacgactggtgaggtccttcggagaccctgtccctcacctgcgctgtctntggtcgcctcatcagtagttcgtttctcgtggggctgggtccgcagtcctaccggagggaacgggtcgtaggaatactagttaggaagtgtcgtctntagtaggtcggtacggttcctaagttacgacgttccgtactccgtacgaaagtcgtacggacgttaccaccgtaattactccgttcgtacggtaacctaccgttaaccgaacgtacttaaacgttccgtttaaccgttttacccgaaggtaaacgtacgttacggttaacgttcgttacggttacggaaccccgtcccggtcgtacggtaaccggttacggggtttaaccttttagtacgttcggtacggttacgaacgtacgggtacgttacgttagttaacgttggttttacggtttagtaggtttaccgtttacgtacgtacctaacgtacgtacggtcggtacggtcctacccgggtccggtacgggtcgaacggttacgttacggttcgtccgttaaccgtccttaccgtactcccgtaacccgg

SEQ ID NO: 142505 - DNA, 602 bp, Homo sapiens
  misc_feature: GYAE6OF02FODG9.46.67.G01.1.454.CMB.1.raw
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggcagcctccgagggaagggctggaatacattgggaagtgtctctcatagtggagttcctattacagtccgtctctcaagagtcgagtcaccatatctctggacacgtcngcaatcagttttccccnganagtgacgttctgtgaccgccgctgacncgggtacgttttattactgtgcgagagacgactattatgtattttggagttggttacttcgtacaccttagacgtcgacgggggtctccggtacccgtcggggcctaggggaaacttccggttaggtccaaccgttcgttacccttacggtccctacccgacccggaacggcccgtacgtcccgggttcctttccccggcggccctaccccgtcccgtacccgaacgacgtaccccg

SEQ ID NO: 142506 - DNA, 636 bp, Homo sapiens
  misc_feature: GYAE6OF02JCMEH.46.67.G01.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactccctcctgtctgacaccggtggacacngtntaccacatcacgtcggccgggacaagtcgaactnttacgactacttaatttaatgtaatacaacagtacgaccggtaggaccgtcctaagccttactaatctancgtcgtnacctactcgtaggttcgaacgtaacggggtccggtaccaggttcggtaggtacgaggtcggcgtaaggtcgtaacgcggtaggtatacgttactttccaaccgttacacaaccttgtaacgttaacgttaancgtagtaacgaacgttaagtaactttnttacgaacttaagttacttacgtacaacgtaactaagttactaagttacgttcggtacgacgtaaggacctataaacgtaacttaaacgtaacgacgttagccgtacacggtactaacctgtctacgttacttacccgtcttaccgtacctctaacgtctagttacc

SEQ ID NO: 142507 - DNA, 675 bp, Homo sapiens
  misc_feature: GYAE6OF02GUNF4.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccgganaagtcggaacattgacaccttaatttaaacttggtatacaacatacgacgaggaccgcccaagctactaatctatgctgcatcctagtttacgacgtaaaggtcgggtaccctagtacggtaggttcgaggtcggacgtaggtgtagtcgtagggtactaagttactttacgaccttacgtacctaaccgtattacgtaagttaacgttcgtagaaccgtaacggtaacggtaaacgttagttttaacgacttaaactttacgtttacgtacgtaactaaacgtaattaaacgtaacttaagtttacggttttacccggaacgtaaacgggtaaccgtaacgaaaccttaaaacgttaaaacgttaaaacggaaacgttcggtaacggtactacggtaccaacccttatccgttagttaccttacgtactttcccgtaccgtcctaattccgttatacc

SEQ ID NO: 142508 - DNA, 669 bp, Homo sapiens
  misc_feature: GYAE6OF02HUREQ.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccggcccacgactggtgacggtcctttcggagaccctgtcccctcacctgccgctgtcctctgggtcncctccatccaaggttagttggtttcttcgtggggcttggggtcccggctagccgtcccgaggggaaggggctaggaatacgagttaggtaagtcgtctctcgtataggtggtacggttctagttactacgtccgtctctacgaagtacgtcgacgtaccacctatactctcgtaggacacgtacagactaacttctacgtttccctagaagtagtcgtacgtttcgttcgtacgacccggtccgctcgacgtacgggttctttaagttacgtgttgacggtagacggacgtactttagttagttcgtttagttttagggagtttggtttacttacgtaccgtacctaaggtacgtccgggaccgggtctacccggtacccggttacgggaccgaagggtaacctacggtcgttaccgaccggtttccttaccggtacctccgtaaccccg

SEQ ID NO: 142509 - DNA, 795 bp, Homo sapiens
  misc_feature: GYAE6OF02FGGTU.46.67.G01.1.454.CMB.1.raw
  modified_base (226)..(226): a, c, t, g, unknown or other
  misc_feature (226)..(226): n is a, c, g, or t
  modified_base (411)..(411): a, c, t, g, unknown or other
  misc_feature (411)..(411): n is a, c, g, or t
  modified_base (761)..(761): a, c, t, g, unknown or other
  misc_feature (761)..(761): n is a, c, g, or t
tcagactagcagtacacgaccggtgctcgatttagagtatacatattggggtttgggggacctcctgtgcaagaacatgaagcacctgtggtttgtcctcctgctggtggcagctccagactgggtcctcgtccctggtcgcaactgcaggacgtccgggcccacgactggtgacggtccttcggacgtaccctcgtcccctcacctgccgtctgtctcgtggtcncctcatcgagttacgttcgtttcctcggtggggtcttcggggtccgcgtacgtcccgtaccggaggggacggtctaggaactcaggttacggacgttcgtccactgtactacgggtacgtacgttacctaattaaccgtcgttcccgtacgttacctacgaagttacggtacgactacctaactnttactccggtacgttacggaccgttaaccgttccgaaacggtaccttaaacgttcccgtttaacctttacccggaaggtaaacgttacgtacgttaccggtttaccgttacgggacccgttaccccggaccgttaacggtaccggtaaccgggtttccggtttaaaccggttttacctacgggtccgttagggtacccgaaggacccggtttagtacctttaagtacgtttggtttagtttacggagttttaacgttaccgttacccgaaccttaaaggtccggtacggtaccgggtcggaccccttacccgggaacccgggtcggtaacggagtttaccgccggttacncccggttacctcctacgtacccgtactaaccccg

SEQ ID NO: 142510 - DNA, 646 bp, Homo sapiens
  misc_feature: GYAE6OF02FQ8LB.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatggtgacatcgagctgacccagtcctccatccctccctgtctgacaaccggtgggagacagtgtccaccatcacttggccgggacaggtcggaacnttcgacctaccttatttaatgtatcaacatacgaccagggaccgcccctaagcctactatctagtcgactgctacttcctaggtttcacgtaaacgggtccgggtaccctagtccgtaggttcaggtgacagggtggactcggtagggactagtactttacacgtcctaccaacgtactacgtaagtacgttcgacggtactaaggtagtaagttactttagtaacttaacgtttacttacgttacgtaacaacgtaagttaacttacgttaagtttacggttttacccggaaccgaacggtaactaacgtaacttaacgtaaaacttaaacgtaactaggtcgtacgtacgacgtacacttacgtcttacgttactacgttcccggttaccctctacttagtactacg

SEQ ID NO: 142511 - DNA, 805 bp, Homo sapiens
  misc_feature: GYAE6OF02HUO18.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctcgacccagtctccactcctccctgtctgacgaaccggtgggacacagtcgtccaccatcacttcggccggataaggcgaactgttacgacctaccttaatttaattggtactaccaactagtacgaccgagggacccgtacccctacgtacctacctaatcctatacgtctagtacctacgttcctagtttcgaacggtaaacgggttccgggtaccctagtacggtacggtttcgaggttcggacgtaggttacggtacgttacggtacggggaactacggttaacctttacctaaccgttaccgtaccctaaaccgttacgtaacgtaaccgttaacttaccggtacggttaaaccggtaaacgggttaaggttaaacgtttaccgttttaacggtaccctttaaacggttttaactttaaccgttacggtaaaccttaaacggtaaacgtttaaacgttaaccttaacgggttttacgtttaacccgggaaccgtaaacggggaccttaaaccgggtaaaccttaaacgttaaaaacgttaaccggtagttacggtaccggtacgtaccggtactaacccgtacgtttacgtccttaccttacctacccgtttaccgtacccgtaccgtttacttcgtacgtaaccg

SEQ ID NO: 142512 - DNA, 834 bp, Homo sapiens
  misc_feature: GYAE6OF02JE0NZ.46.67.G01.1.454.CMB.1.raw
  modified_base (178)..(178): a, c, t, g, unknown or other
  misc_feature (178)..(178): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccctttcgggacgaccctgtccctcacctgcgctgtctcgtggtcncctccatcagtacgttggtttctcgtgggtctgggtccgcgacgctccccgaggggaacgggtctaggtaatacgtagttagggacgtcgtctctacgattaggtggtacgttccgttattaacgcgtccgtactctaccgtaagtacgtacgtacgtacacctactacttccgtacgttacggaccacggttcccaagtacctaacgttccttacggtttttcccacggtaaaggtacttacggtaagtttctcggtaccgtaccgtccgtcggtaccggtacggtaacgggttcgttttacgttaccgtggtacggcgaggacggtaccgtagttattaggtttacgttagttttagggttacgtttacggttttacgtttacccgtaacccgttaaccgtaacgggtttaccgacccggggttaaccgggggtaacccctaccccgggttacccccgggtagggggtaaccccgaaacgggggttaaccttcccgggtttagtaccccgtaaccggtttcctaacccgttccggtacccttaccccggaccggttaaacccgggccctaacggtttcccggttacccccgttaccccgggtaccgtaccccgttaacccgttccccaacccggttacggaaccccgttcccgg

SEQ ID NO: 142513 - DNA, 669 bp, Homo sapiens
  misc_feature: GYAE6OF02I0BX0.46.67.G01.1.454.CMB.1.raw
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatccctccctgtctgacaccggtgggacacgagtcgaccaccagtccacgtttcggcccgggataacggtccggaactagttcgaacctaccttaattttaaagtggtaatcgaacatacgaccgacgggaccgcccctaagcctacctagtactatcgctgctactcctagtttcgacgtaaggtccgggacctagtcgtaggttcaggtcggcaggtagngttcgnggactaggttcttacgtctactacgacctactaacgtatactcgaactacgtaacgtgtaagttacgttactaacgttaacttactttacacggttaaccaacgtaacttaacgttattaaacggtttaccgtttacggtaccgtaacggtaacctaacgttaactaaaccgttaaactaacgtaaagttcgaggtacctacgtaccgtaacttaactaggtcctttacggtaccttacggttacccacccggttacctacttacgtagttaaccg

SEQ ID NO: 142514 - DNA, 712 bp, Homo sapiens
  misc_feature: GYAE6OF02GNCPK.46.67.G01.1.454.CMB.1.raw
  modified_base (171)..(171): a, c, t, g, unknown or other
  misc_feature (171)..(171): n is a, c, g, or t
  modified_base (347)..(347): a, c, t, g, unknown or other
  misc_feature (347)..(347): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgtttcttcgtgggctgggtccggcagcctcccgaggggaagggctggaatacgagttggaagtgtctctcagtgtggaggttcctattacgagtccgtctctcaagagtcgagtcacctatactctcgtggacacgtccagacaatcttacgtttccagaanagtgtagttcgtagtcgaccggcgtctagacgtacgggttactttattaccgtgtacgtacgaggtaacgtacggtacttagttagttagtttagttttaggggtagtttacgggttttactttccgtaaccgtaaccgttaggtacgttaccggggtacggggtccgttacccgggaccccgggttacggggacccgaaaggggttaacttacgggttacggtaccgtacccggttccgttacccgttaccgttacccgaccgtaacccggtaaccgggaccctacgggttccccggtaccctttcccccgtacccgggtcccctaccccgttccccgtaacccgtacggtccgtaacccccgg

SEQ ID NO: 142515 - DNA, 807 bp, Homo sapiens
  misc_feature: GYAE6OF02JCK89.46.67.G01.1.454.CMB.1.raw
  modified_base (403)..(403): a, c, t, g, unknown or other
  misc_feature (403)..(403): n is a, c, g, or t
tcagactagcagtacacgaccggtgctcgatttagagtatacatattgggtttgtcctcctgctggtggcgagctcccagatgggtcctcgtccctggtgcaactgcaggagtcgggcccacgactggtgaggtccttcggagaccctgtccctcacctgccgctgtctctggtgcctccatcagtagtggtttcttcgtggggctggggtccggctaggcctcccgaggggaaggggctgggaattacgagtttggaagttcgtctctcattaggtggaggtttcctagttacagtcccgtatcctacgaaagtgtcggaattcaaccattacttccgtctcgggaacctaccgtcccaaggtccaaacgttccgtaacggtttttccccaggtaaaacgtnttggtaacttcgtaggtccgaaccgtccggcgttgaaaccgtcggggttaccgttttaattacccgtggttacgacggtaacgtacgggtaccgttacttaaggtttattacggtttaggtttttacgggtaagggtttacgtttacccgtttacgaaacccgttacccgttaaacgggtacgttaccgggggtaacccggggtcccgtacccggtaacccgggtccggggtaccgaaacggggttacttaccggttcgggtaacccgtaccccggtttactttaccggtaccctcccgttaaccggaaccggtacccggggtaccccttaaggttcccggttccccgttttaaccccggccggtacccctaccccgttccgtaccgaaccgttcccggacccg

SEQ ID NO: 142516 - DNA, 769 bp, Homo sapiens
  misc_feature: GYAE6OF02IQAM0.46.67.G01.1.454.CMB.1.raw
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtcccctcacctgcgctgtctcgtgcgcctcatcagtagtgtttctcgtgggctcgggcgcagcctccgnggagggctggatactgtaggagtgtntctacatagtggacggttcctattacacgtccgtctctacctaaggacgtcggatctaaccgatactccttctcggaccgtaccgtacccgacgtacgtaaacttctaaccgttttccccgtaggaaacgtaagttcgtacgtttacgttcggttaccgggtaaccccgcccgtacccgttagacccgtaaccggggttcgtttaacgtttacgttggttccggtacggtaacggaggtacccgggttacttaacgtttaagttgtttaaggtttttttggggtagggttttaacgggtttttacgttttaccgtaaccgttaacccgttaagttacgttacccgggtacggggggttccgtaaccccggggtccccggttaaccgggggtacccggtaaacgggttaccggttaacccgttacgggttaccccgttaaccgttaccccggttacccggttttacccggtaccccgttaacccccgg

SEQ ID NO: 142517 - DNA, 718 bp, Homo sapiens
  misc_feature: GYAE6OF02IQ2LO.46.67.G01.1.454.CMB.1.raw
  modified_base (329)..(329): a, c, t, g, unknown or other
  misc_feature (329)..(329): n is a, c, g, or t
  modified_base (369)..(369): a, c, t, g, unknown or other
  misc_feature (369)..(369): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtgtttcttcgtggggtctggggtccggcacgtccgtcccgagggagggctaggaatactagtggagtgtctctacagtagtggtagttacctattacacgtccgtcttctacgaagtacgtacgagtcaacctattactcgtcncggaccacgtaccagacaactactacgttttccagtaagntcgtagttctagtccgaccgcgtcgtacgtacgtacggtcttttagtacgtggtacggacgagtacggtacgtatttagttagttaggtttacgttttaggtacgggtttgttacgtttaccggaacgtaaccttaggtaccggtaacgggtaccggggtacctacccgggtacccggttagggggaccctaacggggtaacgtacggttccgtaaccctaccggttctacccgttacggccccgtaaccacccggtaaccggtacccgtaccgtttcccggttacccccgtttccccgttaccggaccccttacccccttcgggtaacccctaggcccttaaccccgg

SEQ ID NO: 142518 - DNA, 682 bp, Homo sapiens
  misc_feature: GYAE6OF02GNFFG.46.67.G01.1.454.CMB.1.raw
  modified_base (393)..(393): a, c, t, g, unknown or other
  misc_feature (393)..(393): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggagtcgggcccacgactggtgaggccttcggagaccctgtccctcacctgcgctgtctctggtcgcctcatcagtagtggtttctcgtggggctgggtccggcagcctccgagggaaggggctggaatacattggaagtgtctctcatgtggaggttctattacacgttccgtctctacaagtcgtcgagtcacctatatcctgtacggactacgtctagactaaatctagttttccctagaacgtntagtacgtttctggttacgaccggccgcctggtaaccgtacgggtacgttttaagttcgttagtgtccggaaggtacggtacgggtaccttaagtttaacgttggttaacgtttttagggtagggttttaaggtttactttaccgtaccctaaaccgttagaccggttcgggtacccgggggtcgttacccggaccccggggttacgggtacccggtaacgggttaacgtacccgttaggtacccgttaccggtccgtttaccccggttagttaccccgtaacccccgg

SEQ ID NO: 142519 - DNA, 626 bp, Homo sapiens
  misc_feature: GYAE6OF02IS0ER.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtccaccatcacgttgccgggacaaggtccggaacattgacaccttaatttaatggtatacaacatagaccgagggaccgacccctaagctactaatctatcgctgctactcctaggtttagacgtaaggtcgggtccctagtcggtaggttcaggtgacgagtggtactcgtagggaacgtagttacgtttaccgactacctaccctaactacgtacgtaagtaacgttcttacgacgtaacgtagtaaagttatttacgacctaactttattaccgttagtaccaagtaacgttaacttaacgtaacgttggtttaccgaacggtaacggactaacgaacttaaactaaaacgtaactaacgtgtacgactacgacctacgtacttctgtacttactacgttcccttccacctacttactgtaccg

SEQ ID NO: 142520 - DNA, 767 bp, Homo sapiens
  misc_feature: GYAE6OF02FV18Y.46.67.G01.1.454.CMB.1.raw
  modified_base (174)..(174): a, c, t, g, unknown or other
  misc_feature (174)..(174): n is a, c, g, or t
  modified_base (262)..(262): a, c, t, g, unknown or other
  misc_feature (262)..(262): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctcgtggtcncctcatcagtagtggtttctcgtggggctgggtccggcagctcccgaggggtaagggctggaatcgaagttgggaagtgtctaccgtntagtacgtggaggttccttattacagtccgtctctcgaagacgtcgacggtcacccatactctctggacacgtccagcaatccgtacgttttcccagaaacgtagtcgagttcgtgtcgtaccgcgtcgtcgaaccgtacggggtacgttttaattaacgttcggtcgcggtaagtacggaaccggtacttaagtttaagtaggttacgtttttaagggtagtttcgggtttaacttttaccggaacccgtaacccgttaaggaaccggttacccggggtacgggggtacccttacccgggtaacccccgggtacgggggtcccggtaaaggggttaaacctacggttacccgggtactaaccccgggttcctttacccgtaccggttccccgtacccgtaaccgggtaaaccgggtccccgttaaacgttccccgggttaccctttacccccggttggaccccgtttacccccgtccctaacccgaacggtacccgtaccccgg

SEQ ID NO: 142521 - DNA, 627 bp, Homo sapiens
  misc_feature: GYAE6OF02GVJZJ.46.67.G01.1.454.CMB.1.raw
  modified_base (173)..(173): a, c, t, g, unknown or other
  misc_feature (173)..(173): n is a, c, g, or t
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (399)..(399): a, c, t, g, unknown or other
  misc_feature (399)..(399): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagacccctgtccctcacctgcgctgtctctggtncctccatcagtagtgtttcttcnggggctgggtccgcagcctcccgaggggaagggctaggaatacgagttgggaagttgtcctctacataggtggtaggttcctaattaccagtcccgtctctcaagngtcgagtcaccatatctctggacacgtccagacaatctagttttccccagaagtatgagttctgtcgaccgccgctagacgacgggtctttatacgngtgcgagagacggactattagtgttagtttggtagttgttatttcgactacccgttagtacgtaccggcggggtactccgacccggtcggggaccgagggtaacgtacgtcggtccgtaccgtccttaccgttacgtccctacccgaccgaaccgggacccgtacgttcccggttacccttccccccgtacggccctaccccgttcccgacccgtacgacgtaccccg

SEQ ID NO: 142522 - DNA, 617 bp, Homo sapiens
  misc_feature: GYAE6OF02JE1FC.46.67.G01.1.454.CMB.1.raw
  modified_base (462)..(462): a, c, t, g, unknown or other
  misc_feature (462)..(462): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccctagtctccatccctccctgtctgccaaccggtgggagacaggtgtcaccatctacttcgcccggggacaacggttcggaactattcgactacccttaattttaaaattggtaactcaaacatacgaccgacggggaccgcccctaagcttacctaatctatgctgcatcctagtttgacgtaaaggtcgggtaccctagtcggtacggttacaggtgggtactaggtggacttcggtcggatacgtactttacgaccttctacaactagttacagtaactctagactaggactagttcgtttnacttaacttatagttcactaaactagtaacttataacgttcgtttaacggactaagggacctaagtaactaaataaacgttaaacgaacttgacgtacgacgtacacgttactcttacgttactcgttacgtcccttacccgctactcgattacg

SEQ ID NO: 142523 - DNA, 644 bp, Homo sapiens
  misc_feature: GYAE6OF02IUNJ0.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaacggtggganacagtcgtcacatcacttggccggcaaggtcggaacattcgacctaccttaatttaaattggtatacaacatagaccgacggacggacccctaagctcctaatctatgctgcatcctagttgacgtaaggtcgggtccctagttcggtacgttcgtaggtggtcgtaggtggtactcggtagggtactaagtactttacgtactcctacgtaccagtactaagttaactcgtacgaaccgtaacggtagtaacgtttagtttacgacctttaaacgtttacgttaccgttataacgtaaactaagttaaacttaactaagttttacggttacgggtaaccgtaaaggaacctaacgaaccttaaacgttaaaacgtaacgtaacgtacgtagcgtaccgaccgtaactctcgtccgtacgttactaccgttcctcccgaactctcgtagtac

SEQ ID NO: 142524 - DNA, 678 bp, Homo sapiens
  misc_feature: GYAE6OF02IMN7D.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttcgtgggctgggtccgcagctccgagggacgggctaggaatacagttggaagtgtctctcatagtggaggttctattacacgtccgtactctacaagagtcgagtcaccatactctctggacacgtcagcaactctatttccngtaagatgtagtctgtcgaccgcgtcgtcgacgacggtacgtttagttactgtcgcgaagtacggacggtacgttaacttagttagtttaagttttggaggtttaggtttaactttccggtaacctacccgttaagtacgttacgggtaccgggggtctacccgggtaccccgtacggggtacccgtaaggggtaactaccgttcgggtacccgtacccggttccttacccgttacgtcccctacccgaaccggtaaccgggtacccctaaggtttcccgggtaccctttacccccggtacggcccttaaccccgtcccgtacccgaacggtaccgtacccg

SEQ ID NO: 142525 - DNA, 748 bp, Homo sapiens
  misc_feature: GYAE6OF02HLZRO.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacggactggtgaggccttcggagaccctgtccctcacctgcgctgtctctggtcncctccatcagttagttggtttcttcgtggggcttggggtccggcagcctccgagggagggctggaatacagttggaagttgtctctctagtaggtcggtacggttccttaagttaccgaggttcccggttcttccgtaacgtaaacggtaggttaccggtacggttaccaaccgtaattaacgttccttacggtacgggtaacctaaccggttcccgaagtacctaaacttacgtttaccgtttttacccgaggtaaacgtagttacgtacgtttcgtggtacgacccgtccgtctacggaccgtacggggttacttttagtacgtggtcgacggaggacgtacggtcttaagttagttaggtttaggttttggtaggtttacggtttacttaccgtaaccgtaccgtaggtcgttaccggggtaccggggtcctacccgggttacccgggtcggggtaacccggtaagggttacctacgggtttccggtacccgtaccggttacccgtttaccgttacggacccctaacccggg

SEQ ID NO: 142526 - DNA, 809 bp, Homo sapiens
  misc_feature: GYAE6OF02H6MFT.46.67.G01.1.454.CMB.1.raw
  modified_base (216)..(216): a, c, t, g, unknown or other
  misc_feature (216)..(216): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (780)..(780): a, c, t, g, unknown or other
  misc_feature (780)..(780): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggacgaccctgtccctcacctgcgctgtctcgtggtgcctccatcagttagtggttttcttcgtgggctgggtccggcngcctccgaaggggacgggtcgtaggaatacgtagttacgggaagtcgtcttcgtctaagttaggtaggtacggttccttattacgacgttccgtctctanaacgngtacgactcacctatacttccgtcgtacggacctaccgtaccgagactaactacgttacgtttttcccgaaggtaatcgttagttacgtttaccgtcggtaccgacccggtcccgtacgttaccggacgggttaaccggggtttaccgttttacgtttacgtcgggttcgggaaacgggtacggttaacgggtaccggtactttttaacggttagtttaggtttttaaggttttcggggtagttttagggtttttaacctttacgtaacccgtttaaccgtaaggttacggtacccggggtccggggtaccgttacccggggtacccggttacgggggaccgtaaggtaaccgtttcggttacggtacccgtacccgttccgttaccgtaccgtcccgaaccggtacccggtaccggtacccgttccggttacccgttcccgtaccccgtcggtacccncccgttacccgtacgtaccgccgtacccg

SEQ ID NO: 142527 - DNA, 727 bp, Homo sapiens
  misc_feature: GYAE6OF02GJ939.46.67.G01.1.454.CMB.1.raw
  modified_base (241)..(241): a, c, t, g, unknown or other
  misc_feature (241)..(241): n is a, c, g, or t
  modified_base (446)..(446): a, c, t, g, unknown or other
  misc_feature (446)..(446): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccacgactggtgaggccttcggagacccctgtcccctcaccttgccgctgtcctctggtcgcctccatcagtagttggtttctcgnggggtctaggggtccgcagcctccggagggaagggctaggaactacgagtttggaacgtcgttactcgtactataggtacgggtacgttctattaccgtacgtccgtactccgtcaaggtagtcgtaggtccacctattacgtccttcgagggtaacctaccgtaccaagacctaagttccgtacgttttcccgtagtaaacgtnttacgtacggttcgtacggttccgacccgggccctgtacggaccgtacccgggtttattttaacttaccgtggtaccgtacgaacgggttacgaaccggtctttaattacgttgtttaggtttttcgggtaaggttggttttaactttccggaacctaccttagggtagtaccgggggtaccgggcttaccccggtaccgggtaccggggtaacgaacgggttaaccttacggtcccggttacgtacccgtttcccgtacgtttacccgtccgtaaccccg

SEQ ID NO: 142528 - DNA, 584 bp, Homo sapiens
  misc_feature: GYAE6OF02FPDS4.46.67.G01.1.454.CMB.1.raw
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (398)..(398): a, c, t, g, unknown or other
  misc_feature (398)..(398): n is a, c, g, or t
  modified_base (500)..(500): a, c, t, g, unknown or other
  misc_feature (500)..(500): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcataggtggaggttcctattacagtccgtctctcaagagtcgagtcaccatatctctggacacgtccagcaatctcgttttcccnggaanattgagttctgtcgaccgcgactcggacgtacgggtctttattacgtgtgcgagngacggtcttattatgttagttttggagttaggtttatttcgactacctagactcgggacggggctccggacccggtgggaccgtagggactcgtcgggtccnccgttctcgttacgccgtacccgacgacgggtcccaggttcccgttccttccccgcgtccctaccctcctaccgacgcgtaccc

SEQ ID NO: 142529 - DNA, 706 bp, Homo sapiens
  misc_feature: GYAE6OF02GJB8A.46.67.G01.1.454.CMB.1.raw
  modified_base (206)..(206): a, c, t, g, unknown or other
  misc_feature (206)..(206): n is a, c, g, or t
tcagactagcagtacacgaccggtgctcgatttagagtatacatattgggtttgtcctcctgctggtggcagctcccagatgggtcctgtccctggtgcaactgcaggatcgggcccacgactggtgaggccttcggagaccctgtccctcacctgcgctgtctctggtgcctccatcagtagtggttcttgtgggctgggtccgnagcctcccgagggagggctggaatcgagttggaagtgtctctcagttaggtggtacgttcctattacgacgtccgtctcgtacaagtgtacgtagtccacctatatcctcgtcgactaccgtccagacacttctacgttttcccagtacgtatgtacgttctagtaccgacccgcccgtcgtacggaccgtacgggttccgttttactacgttgtacgtacgagtacggtacgtaattacgttagtagttagttttagggagtttaggtttacgttaccgtacctaaccgtacgtacggtcccggggacgggtaccgtaccggtcccggtacgggacccgtaagggtacgtaaccggtcggttcctaaccccggttctacccgttaccgtcccgtaacccgtaaccggtaccggaccccgtacggttacccccggtttccctacccccggttaccggcccctaccccgttcccgaaacccgtacgtacccgtaaccccgg

SEQ ID NO: 142530 - DNA, 961 bp, Homo sapiens
  misc_feature: GYAE6OF02G306J.46.67.G01.1.454.CMB.1.raw
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttcttcgtgggctgggtccgnagctccgaggggagggctaggaatacgagttaggaagtgtctctacgtattaggtggtacggtttcctaatttaccgacggttacccgtcttactacgtaacggtacgtcggtaagtcccgaccctaattaatccttacggttacgggaaccctaacccggttaccacggtacctaaaacgttaccgttaaccggtttttttcccccgaaaggtaaaacggttaacgtttacgggtaaacggtttttccgtacgggttaccggaaccccgggtcccggtaccgttaccggggtaaacccggtaaccgggggggtttaacccttttttaaaggtttaccggtttagggttccgggaccggttaacgggaaacggtaaccgggttaccgttttaagttttaaccggttaaggttttaggttttttaggggtacgggtttttaacgggtttttaacgttttacccggtaaccgtttaaccccgttaacggtaccgggttacccgggggtaaccgggggtaccgttaccccgggaacccccgggttcggggaacccgggtaacggggtaaacttaccgggtaccgtttacccggacccgttttcgtaccccgtttacgtaccccggttacccgtaaaccccgggaacccgggttaccccgttaacggtttccccggttacccccgttaccccccggttccggtacccccgttaccccgttaccccggttaaccgaacccgtaccggttaacccccgg

SEQ ID NO: 142531 - DNA, 640 bp, Homo sapiens
  misc_feature: GYAE6OF02JKJVP.46.67.G01.1.454.CMB.1.raw
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacngtgtacaccatcacttgccggganaagtcggaacnttgaccaccttatttaaacttggtatacaacatagaccagggaccggcccctaagtcctcctaatctatgctgctatcctagtttgacgtaagtcggggtaccctagtcgtacggttacagtggccgtaggtcggtatcgagggactagtattacactactcacgatctagtactcgtcgactacgtagtaattacgtttagacttaacgtttattacgttacgtacaaacgtacgtaatttaaccgagtttacgtttaccggaccgaaaggtaccgtaaaccgtaacttaaccgtaaaacgttaaaccgttaactaggtaccgtcgttacgacccgtaaccgtacgttcttaaccggttccttacgttaccgttccttacccggtaccacgtttacctaggttaaccg

SEQ ID NO: 142532 - DNA, 789 bp, Homo sapiens
  misc_feature: GYAE6OF02JYDEJ.46.67.G01.1.454.CMB.1.raw
  modified_base (161)..(161): a, c, t, g, unknown or other
  misc_feature (161)..(161): n is a, c, g, or t
  modified_base (407)..(407): a, c, t, g, unknown or other
  misc_feature (407)..(407): n is a, c, g, or t
  modified_base (453)..(453): a, c, t, g, unknown or other
  misc_feature (453)..(453): n is a, c, g, or t
tcagactagcagtacacgaccggtgctcgatttagagtatacatattggtttgtcctcctgctggtggcagctcccagatgggtcctgtccctggtgcaaactggcgacggatcgggtccaggactgggtcgaggccctttccggacgacccctgtccctnacctgcgtctcggtaccttcgtagtcaccttcaggttctaggttgggttcgaaacgtttcgggtcggtcgtcgggaccgcggtaacggccgtcggaccggtaggcttaggaattcgagttcgtaacgtcgttacgtaggttacgtacgttaacgttacgtacggttaccgtacgttacgtctacggtttacgtacgtacgtaacgacgtactacttactaactccctacgcttaaccttttaaccngttccccgtaacccggtttacgttcgaagttaccgtacgtagtttnaacccggtttttccccgggaaacgttcggtaagttcccgacgtttacgtacgttcgtacgtagtacgtacgttacggtacgtagttagtagtttacggtttaggacccgttacgttacgtacgtaccgtacgtacgtacggtacggaccggtaccggtaccgtacggtaccgtacggtacgtacgtacgttaccgtacgtactacgtacgtacccgtaccgaaccgtaccgtaccgtaccgtcccgtacccgcggtacccggaaccgtgggtaccgtaaccgtaccgtacccgtaccgtaccggtaccgtaccggtaccggtaccggtaccgtcgg

SEQ ID NO: 142533 - DNA, 798 bp, Homo sapiens
  misc_feature: GYAE6OF02JHGAY.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcgcctcatcagttagtggttctcgtgggctcgggtccgnagtctcccgagggagggctggaatactattggaacgtgtacctctacgagttaggtacggttacgttacctaagttacgcgtccgttctcgtaataacggtgtcgtacgtaccacgtattactcgtcggtacacgtacctacgacgtactaacgttcgtttaaccgtttcccaagtaagttcgtacgttacggtttcgtacggtaaccggtcccggaccgttggaacccggtacgggttaccgggttttacgttttaaccgttacggttcggtacggaacggtaacgggtacgggtaaccgttaacgtttaagttttaccgttaaggttttaggttttacccggggttagttttaagggttttaccgttacccggttaaacctaccgggttaaacgttccgggggttaacccggggttcggggttaacccgttccccgggaaccccgggggttaagggtaccggtaaacgggtacccgttggttaaccccggttccggtttaacccgtcccggtttaacggttccccgtaaccccgttaacccccggg

SEQ ID NO: 142534 - DNA, 705 bp, Homo sapiens
  misc_feature: GYAE6OF02JHQE7.46.67.G01.1.454.CMB.1.raw
  modified_base (175)..(175): a, c, t, g, unknown or other
  misc_feature (175)..(175): n is a, c, g, or t
  modified_base (635)..(635): a, c, t, g, unknown or other
  misc_feature (635)..(635): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctgacctggccgtctgtctctggtncctcatcagtagtgttctcgtgggctgggtccgcagtctacccggaggggaacgggctagggaactcgagttagggaagttcgtctcgtcgaagttaggtgggtacggtttcctaattacgaacggttccgtcttcgtacgtaaaggtcgtcggaagtccaacgtatactccgtcgtcggacacgtccaagcctaaagttcgtacgttttacccagtaacgtagtcgtagttcgttagtaccgacccggtcccgacgtacggtaacgtccggggttacttttaacgtacgtcggtacggtacggtagtaccggtacgagtttaacgtagttcggtttaagttttcggagtttacggtttacgttaccgtacctaccgtagttcgtaccgggtacgggtccgtacccggcccggtagggtaccgtagggtactacgtcgtaccgtacgttccttaccgtancccgtacgacgtaaccgcctagttcccggtccttcccgtcgtccctaccgtcctaaccgtagaccgtccg

SEQ ID NO: 142535 - DNA, 731 bp, Homo sapiens
  misc_feature: GYAE6OF02GLNES.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgctaaccgtgggagacagtgtcaccatcacttggccggnaacgtcggaacattcgactaccttaatttaattggtatcaacatagaccgagggaccgacccctaagctacctatctatgctgcactccgtagtttagaccgtaaaggtcggggtacccagttcggtaacggttcgaggtcggcgtaggtggacttcggtagggtaactagttactttccgacgttcctaccgaacctacgttacctaagttaaccttcgttacgaccgtaaaggttagtaaacgttagttttcggaactttaaacgtttacttaaccgtgttaacctaaacgttaagtaaactttaaccttaaaggtttccggttttaccggaaccggtaaacgggtaaccctaaaccgttaacgttaaaaccgttaaaaagtttaaacccgtaacgttacggttacggtacttacggtaaccctaaccgttacgttaccgttaccgtttaccgttacctacgttttacccccgttacccgtaccttaccgtttaccggttagttaacccgg

SEQ ID NO: 142536 - DNA, 699 bp, Homo sapiens
  misc_feature: GYAE6OF02I9GEW.46.67.G01.1.454.CMB.1.raw
  modified_base (276)..(276): a, c, t, g, unknown or other
  misc_feature (276)..(276): n is a, c, g, or t
  modified_base (423)..(423): a, c, t, g, unknown or other
  misc_feature (423)..(423): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtcctccatccctccctgtctgcgaaccggtgggacgacagtcgtccacctatcctacgttcgccgggacaaggtcggaactattacgactacctaatttaaattggtatacaanatacgacgacgggacgaccctaagtcctacctaatctatgctgactactaccgtagtttacgacgtaaagggtcgggtacccagtcggtacggttacgaggttcggactaagggtggtacgtcggtaggggtactaggttacttacnccgttactaccaccatacgtaatactacgtacgtactaacgtagtaacgttatttacgacttaacttattaccttagtaactaacgtaacgtaaacttactaagtttaccggttacggtaacgtaacgggtaaacaaccggttaacttaaacgtaaaacgttaaaccgtaacgtaggtttacgacgttaacgtaacccgtaaccgttaacttccgttaacccgtttcgttaacccgtaactttcccgttacccgtaccttacgttacgttcgtaac

SEQ ID NO: 142537 - DNA, 758 bp, Homo sapiens
  misc_feature: GYAE6OF02IJDPD.46.67.G01.1.454.CMB.1.raw
  modified_base (169)..(169): a, c, t, g, unknown or other
  misc_feature (169)..(169): n is a, c, g, or t
  modified_base (208)..(208): a, c, t, g, unknown or other
  misc_feature (208)..(208): n is a, c, g, or t
  modified_base (287)..(287): a, c, t, g, unknown or other
  misc_feature (287)..(287): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttgtcctcctgctggtggcagctcccagatgggtcctgtccctggtgcaactgcaggagtcggcccagactggtgaggccttcggagaccctgtccctcacctgcgctgtctctggtncctccatcagtagtggtttctcgtggggctggggtccgnagcctccgagggaggggctggaacttacagttggaagttgtctctctagtaggtggtaggttcctattacgagtccgtntactcgaaagtcgtcgtacgtccaaccgtattactcctactaggacctaccgtccaagcaaattccgtacgttttacccaggaacgtntacggtatttccgagttacggaccctcgtctaggaaccggtagggtttaccgttttaaattccggtggttacgcggtaaggacggtacggttcgttaatttaagttagttaggtttttacggtagggtttacggttttaactttaccggaaccgttaacccgtaggtacggttaccgggtacgggggtacccttcccgggtaccccggtaggggacccggtaagggtaaaccgttcggttacgtacccgtacgttacccgttccgttaccgtcccgttacccgaacccggtaccggaccccgttacgtccccgggtttacccctcccccggttcccggacccttaacccccgttaccgtaacccgaacgtaccggtacccccg

SEQ ID NO: 142538 - DNA, 553 bp, Homo sapiens
  misc_feature: GYAE6OF02FJPB1.46.67.G01.1.454.CMB.1.raw
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtnaagattttgactaaacttattacttntctaaacagtaaatttacaattgttttaccggacctaaaggggtaccacggaacttaacaaaattaaaaccgaacttacggtagtcgtagcaaccattcttacgttcttactacttccttaccccgcctacttcctagtaacg

SEQ ID NO: 142539 - DNA, 682 bp, Homo sapiens
  misc_feature: GYAE6OF02JPUT1.46.67.G01.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagactagcagtacacgaccggtgctcgatttagagtatacatattgggtttggggagtctcggtctaggacacagcatggacatgagggtccccgctcagctcctggggctcctgctactctggctccgaggtgccgagatgtgacatcgtagcggtacccagtctcactcctcctcgtctgacacggtggacgacngcgtacgacnctacactttgcggactacggtacggaactagtacgtactaccgttaattaagttagtactactactaacgtacgaaccgacggaccgggtacccgtaaccgtaccgtaccttaacgttactacgtacgtacgtccgacttcgaccttaacgttgaccctaaaggttcggggaaccccttagtccggtagggttccaagggttcgggactacggtgggaactccggtaggttaccacggtatttccgaacgttcgtaccaccgtagtcctaaggtaacctacgttaggacctaacggtttcgaacgtacgttttgaacttacgttactaacgtagttacttaacgattacttacattcgttacgacgtagacctaggtactaactaacgtaacatagacgtacgtagtcctacgtactccctagttactacgtactttccgtacctacgttaccgttacctacgtacttaccgg

SEQ ID NO: 142540 - DNA, 819 bp, Homo sapiens
  misc_feature: GYAE6OF02F079S.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgcaactgcaggagtccgggcccagactggtgaggcccttgggacgacccctgtcccctcaccgtgcgctgtctcgtggtcncctcatcagttgtggttttctcgtgggggcttcggggtccgacacgccgtcccggagggggaaggggcctgggaatacgtagttaggaagtgtctctcagttaggtggtacggttccctatttacgacggttcccggtactctctaaggtacgtcgtagtccaacctagtactctcgtacggactaccgtccagacctaaacttccgttacggtttttacccctaggtaaacgtacgttaggtaacgttttccgtaggtaccggaccccggtaccccgtcgtaccggtaaaccggtaccgggggttaacctttttaacgttacggttcggtggtaccggtaaggtaacggtaccgggttacctttaagtttacggttaggtttaaggttttttcgggaacggtttttcgggttttaacgtttacccggtaacccgttacccgttaaggtaaccgggttaccggggtaccgggggtacccgttacccgggtaccccgggttacgggggaaaccccgtaaggggtaaccgtttaaccgttacggggttacccttaaccccggttcccgtttaacccggtttaccggccccccgttaaccccggg

SEQ ID NO: 142541 - DNA, 987 bp, Homo sapiens
  misc_feature: GYAE6OF02G1J3O.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtctccatccctcctgtctagcctaaccggtgggacgactagtcgtccaacctagttcccacgtttcggacccggggtactaaagggttaccgggaaactacgtttacggaaccctaaccgttttaaagtttttaaaacgttcgggttaaacttacctaaaacgtaattaaccggaaccgaacgggggtaaccccggtaccccccgttaaaaggtccccgtttaacccttaaacgtttacccgttaacggttacgggttccttaccgggtacccgtaacctttaccccgttaaggtttttccgaaacccggtaaaaacggggttttccgggggtaaccccctaaacggtttccgggtaaaccggggttttacgaaacggggttcgggtaaccgtaaagggggttcggtaacgttcccgggttagggtaaccgaagttaccggtttttacaaccgttcccttaacgtaacccgtagtttaaccgtaaggtttaaccgttacgtttaccgaaaccggttaaaccgttaggttaaacgttacttttacggaaaccttaaaccgtttacgtttaacgtaacgttaaccgtaacgtaaacgttaaacgttaacgttacggttttacggtttaacccgggaccgtaaacggggtaaccaacggtttaaaccctaaaaggttaaaaccttaaaacggtaccttaaggggttaccgttaaccgttaccgaacccgttaaccgttaactttcgggttaacctttaccggtttaccctaaaccggtttccccggttaaaccctccgttaaccgtttaccggtaagtttaacccgg

SEQ ID NO: 142542 - DNA, 676 bp, Homo sapiens
  misc_feature: GYAE6OF02JZQZA.46.67.G01.1.454.CMB.1.raw
  modified_base (151)..(151): a, c, t, g, unknown or other
  misc_feature (151)..(151): n is a, c, g, or t
  modified_base (264)..(264): a, c, t, g, unknown or other
  misc_feature (264)..(264): n is a, c, g, or t
  modified_base (331)..(331): a, c, t, g, unknown or other
  misc_feature (331)..(331): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctggtccctggtgcaactgcgagggnggtccgggcccacgactgggtgacggccttcggagaccctgtcccctcaccgtgcgctgtctcgtggtcgcctcagtcagttagttcgtttctcgtggggctcgggtacccgnacgcctccgaggggagggctaggaatacgtagtggaagtgtctctcatagtggtacgttcgtatacncgtcgtctctacagtagtcgtagtcaccgatactctacgtgacgacgtcagctaatcttaacgtttccagtagtatcgtagttcgtgtacgaccgccgtacgaggtaccgtacgggttacttttaacgttactcggttacgacggtaacggcgtaacggtccttaagttgttacgtttaagttttcgggtaggtttcggtttagttaccgtacgtaacccgtaggtaacgttccgggaccgggtccttacccgggacccggtacgggtaccgtaagggttaaccgtcggttacgggtacccgtcccggtttacctttaccgggttaccctcccggttaaccccgg

SEQ ID NO: 142543 - DNA, 556 bp, Homo sapiens
  misc_feature: GYAE6OF02IG5H7.46.67.G01.1.454.CMB.1.raw
  modified_base (97)..(97): a, c, t, g, unknown or other
  misc_feature (97)..(97): n is a, c, g, or t
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgaccccagtctccatcctccctgtctgcaaccggtggganacagtgtcaccatcacttgccgggnaagtcggaacattgacactaattaatgtatcaacatagacaggacggccctaagctacctaatctatgctgcatcctagtttcgacgaaagtcgggtacccagtcgaggttcagtgcagtgatctggacagatttcactctcacatacgagtatctgctaaagtgatatttgactaacttattacgtatacaaanagtaaattacaaagtttcgttacggtaccgaaaggaccgaacgtaacttaaacgtaaaagttaaacgtaacgtgtagaccgtgaccctaactactaccttagttactacctcttacccgttacccgacctattcctagtaac

SEQ ID NO: 142544 - DNA, 734 bp, Homo sapiens
  misc_feature: GYAE6OF02I2N6B.46.67.G01.1.454.CMB.1.raw
  modified_base (101)..(101): a, c, t, g, unknown or other
  misc_feature (101)..(101): n is a, c, g, or t
  modified_base (245)..(245): a, c, t, g, unknown or other
  misc_feature (245)..(245): n is a, c, g, or t
tcagactagcagtacacgaccggtgctcgatttagagtatacatattggggtttcgggagtcctcggtcacggacacagcactggacatgagggtcccccnctcagcctccgtggggctcctgctacttcgtggctccgaggtgccagatgtcgacactcgagctcgacccagtcctccatccgtccctgtctgaccgaaccggtgggacgacagtgtccaacctatcacgttcggcccgggtanaaacggttccggaaactacgttcggaacctaaccgttaattttaaacgtcggtaataccaactagtacgaccgacggaccgacccctaagctactaatctatgctgcgataccgtagttcgagaacggtcggtacccagtacgtaagtcaaggcgactaggtaggactcggtacggactacgttacttacgacttctaccacctagtactaagtaacttcgtacgacgtaacgtagtaacgttacgtttacgacttaaacttacgttaccgttacgtaactaaacgtaagtaaacctttaaccgttaacgtttacggtttaaccggtaaccgtaacgggtaaccaaccggttaactaaacgttaaaacgttaaaccgtaacgtaggttacggtacctacggtaaccctaacgttaaccgtaccgttaacgttacccgtttaacgtacccttacccgtttaccccgacttaccgtaccgtacgttaaccg

SEQ ID NO: 142545 - DNA, 701 bp, Homo sapiens
  misc_feature: GYAE6OF02I73B4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtgggagacagtgtcaccatcacttcggccgggacaaggtaccggaactacttacgacctaaccttaattttaaagttggtatacaaactataacgaccgaaggggaccggacccctaaacggccttaccgtaatccttatcggtctgctactcctagttgacgaaggtcgggtcctagtcgtaggttcgaggtcgagtagtcgagtcgtagggactaagtactttacgtacttctaccactactacgtaagttactctacgtactaaccggtagtaaagttagttttacgaactttaactttaacgtttacttacgtaacctaaacgtaaagttaacgttaactaagtttcggttttaccgaaccggttaacggaacgtaacgtaactaaaccgttaaaacgttaaacgtaacggttacgtacggtacgttaggacctaaccgtacttacgttacgttacctttaccgttacctttacccgttaccccgtaccttacgttacgtacgttaaccg

SEQ ID NO: 142546 - DNA, 834 bp, Homo sapiens
  misc_feature: GYAE6OF02IHQN7.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtcgccagatgtgacatcgagctacgaccagtctccactccctccctgtctagcctaaccggtgggacgacgtagtcgtacgacctaatcctacgttccggaccggggtacaacggttaccggaaccttagttacgaacccttaacctttaaagttttaaagttacggttaactaccgtaaaatacgttaaccggaaccggaacggggacccgttacccccgtaaacggtcccttaacccggttaatcccgttaagtcccgtactcgtaccttaagtccgttacggtttacgacggtaaacgggttcgggtaccctaagttcggtacgttcgtaggtcggactacgggtacgtacgtacggtaacgggtactacgttaacctttcgacccgttactacccgtaaccctagtaacccttaagttacgtcctaaacggtaccgtaaaacgttaggttaatttaccgttaacaaacgttttaacgttacttacggttaaccgtaactaaacgttaaactatttaaccggacgttttcccgggttaaccgaaacgttaaccgggtaccaaccggttaaccgttaaaccgtaaacgttaaactccggttagtacgtcccgaacggtaccctacgtacttcggttaacctttaccctaccgttaccgtttaccctaccccgtaacttcgtaccgttaaacgttccgg

SEQ ID NO: 142547 - DNA, 600 bp, Homo sapiens
  misc_feature: GYAE6OF02G1N8T.46.67.G01.1.454.CMB.1.raw
  modified_base (289)..(289): a, c, t, g, unknown or other
  misc_feature (289)..(289): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacattggaagtgtctctcatagtggaggttcctattacagtccgtctctcaagngtcgagtcaccatatctctggacacgtccagcaatctagttttcccagaagntagtagttctgtcgaccgcgctgacgacggtctttatcgtgtgcgagagacggtcttatagtgttagttttggagttggttactttcgacctaccgtagtacgtcgggccgggtcgtccgacccggtcgggaccgagggtaacgtacgtcggtccaccgttcctaccgtacgtcccgtacccgtaccggtaaccggtccctacgttcccggttcccgttccccgtacggccctacccgtcccgtaccacggtctacccg

SEQ ID NO: 142548 - DNA, 831 bp, Homo sapiens
  misc_feature: GYAE6OF02I7WPQ.46.67.G01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtgtgtttcttcgtgggctgggtccgcngcctccgaggggaagggcgtaggaactacgagttaggaagtcgtctctctagtagtgggtacggttaccttagttactacggttccctctcgtacaacggacgtcgtacgtccaacctattacttccgtcgtcggaacctaccggtaccgacgtacctaaacttccgttacgtttttcccgaagtaaacgtagttacggttacgtttccgtacggtaccgacccgggtaccgtcttacgggaacgttaccggggtttacgttttaacgtttacgttacggttcggtaaccgggtaaggtaccggtaacggttaccgttaaagttttagttacgggttttaacggttttttaggggttaacggttttagggtttttaaccgttttaaccggtaacccgttaaaccgttaacgggtaacggttacccgggggtaccgggggttacccggtaccccggggttaacccccgggtccgggggtaacccggggttaaacgggttaaccgtttaaccgggttaccgggttaacccgttacccccgggttacctttaccccggtttaccggtaccccccgttaaaccccgg

SEQ ID NO: 142549 - DNA, 917 bp, Homo sapiens
  misc_feature: GYAE6OF02GQ9PM.46.67.G01.1.454.CMB.1.raw
  modified_base (256)..(256): a, c, t, g, unknown or other
  misc_feature (256)..(256): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggcccttggacgaccctgtcccctcacctgcgctgtctcgtggtcgcctccatcagttagttggtttctcgtggggctgggtccgnagcctaccgaggggagggctggaactacgagttggaagtgtacctctactataggtgggtacggtttaccttattaccgtacgttcccggttcttacctacgtaaagtacggtaccgacgttacctaaccctagttaacttcccgtttacggtacggtaacccgtaacccgttacccgaacggtacctaaacgtttcccgtttaaccggttttttacccccgaaagggttaaacggtaacgtttacgggttaaccggttttccgttacgggtttacccggaaccccgggtcccgtccgggttaaccggaaccgggttacccgggggtttaaccgttttttaacgtttacccggttaggttacgggtaccggtaaggtaccggggtaccggttacccgtttaagtttacgtttacggttttaaggtttttttcgggtaacgggttttaggtttttaaccgtttacccgggttaaacccgtacccgtttaagggttaacccggttcccgggggtaaccgggggttcccgtttacccccgggtaaccccgggttccggggggtacccgtaaacggggttaccgtttaccggggtaccggtttaccccggtaccgggtttcccccgtttaacccggtttaccccggtccccgttaaacccccggg

SEQ ID NO: 142550 - DNA, 667 bp, Homo sapiens
  misc_feature: GYAE6OF02GH62F.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagcctcccgaggggaaggggcctggaatacagttgggaagttcgtctctcagttaggtgggacggttcctattacgacggtccgtctctacaagtgtcgagtaccaccatatctctggacctacgtaccagtactaatcttacgttttcccagtaacgtacttgtacgttcgtggtacgacccggtcgtcgtacggacgtacggggttacgttttatacgttggtcggacgaaggacggacggtcttagtttgtagttagttttcgggagtttcggtttacttaccggaacctaccgtagtacgtaccgggtaccggggtcctaccgggtccccggtaggggaccgtaagggtacttacgtcgtacctacgtccttccgtacctcctccgaccggtaccggaccctcggtccgtcccgttcccgcgtaccctcccctccacgtacgtccgtaccg

SEQ ID NO: 142551 - DNA, 585 bp, Homo sapiens
  misc_feature: GYAE6OF02GG1Q3.46.67.G01.1.454.CMB.1.raw
  modified_base (337)..(337): a, c, t, g, unknown or other
  misc_feature (337)..(337): n is a, c, g, or t
  modified_base (559)..(559): a, c, t, g, unknown or other
  misc_feature (559)..(559): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccgagggaaggggctggaatacagttggaagtgtctctcataggtggaggttcctattacagtccgtctctcagagtcgagtcaccatatctctggacacgtcagcaatctacgttttcccngaagatgagttctgtcgaccgccgctgacgacggtctttatacgtgtgcgagacggacggtctattagtggtagtttttggagttaggttactttcgaacctaccgtagtagtcgggacggggtcctccggacccggtcggggacctagggaactcgttcgtccgaccgttctcccgttacgtccctaccaccggacggcccagtcccggttccttccccgngccctaccctcccacgacgctacccg

SEQ ID NO: 142552 - DNA, 692 bp, Homo sapiens
  misc_feature: GYAE6OF02JMJHC.46.67.G01.1.454.CMB.1.raw
  modified_base (95)..(95): a, c, t, g, unknown or other
  misc_feature (95)..(95): n is a, c, g, or t
  modified_base (117)..(117): a, c, t, g, unknown or other
  misc_feature (117)..(117): n is a, c, g, or t
  modified_base (130)..(130): a, c, t, g, unknown or other
  misc_feature (130)..(130): n is a, c, g, or t
  modified_base (141)..(141): a, c, t, g, unknown or other
  misc_feature (141)..(141): n is a, c, g, or t
  modified_base (165)..(165): a, c, t, g, unknown or other
  misc_feature (165)..(165): n is a, c, g, or t
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttggggagtctcggtcaggacacagcatggacatgaggtcccgntcagctcctgggctctgctacnctggctcgaggtnccagatgtganatcgagctgaccagtctcgatccncctgtactgcacgtgganacngtagtcacagtcacttggccggtanaacggtcggaactacgtagacctactatttaacgtgtatcaactagacgacacgggaccgtaccctaagtctacgtaactcgtatcggcttcggacactaccgtagttcgaacgtaacggttcgggacctacgttacgacggttacgtaggacgtacgtaacggtcggtaacgttcggtacgggtacgtagtaactttccgtaccgttactaccgtaaccgtacgtaaccgtacgttaacgtcgtacgtaaccgtacggtacgtaacgttagtttacgaacgttaacgtacgttacgtacgtacttaacacggttaaactttaccgaaggtttccgtaacggttaaccgtaacggtaccgtaaacttaccgtaaacgtaagtaaccgtagtacgtcggtactaacgtccgaacttaccgtacgttagttaaccttcgtaccggtttacgtaccccggagttaacccgtgttacgtaaccgg

SEQ ID NO: 142553 - DNA, 771 bp, Homo sapiens
  misc_feature: GYAE6OF02G5MUI.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattggggtttgggggagtctcggtcaggacacagcatggacatgagggtccccgctcagctcctggggctcctgctactctggctcgaggtgccagatgtgacatcgagctgacccagtctccatcctcctgtctgcaccggtgganacagtgtacaccatctacgttcggccggacaaggtaccggaactattacgaacctaccgttaatttaaacgttggtactacaaactagtaacgaccgaagggacccgtaccctaagcctaccgtaatcttatcgactcgcctaacgttcctaggtttacgaacggtaaacgggttccgggtacccctaggttacccggtaaggttaccgaaggttcggtacgtaggtacggtaacgttcggtaacgggaactaacgttacgtttaccaaccgttcctacctaaccgtacttaccgtaaagttaacgtccgtaacggtaaaccgtaaggttaagtaaacgttttcgtttaaccgaaaccgtttaaacttttcgttaaacggttacgtaaacctaaagttaacttaaaactttacgtaaacggtttcggtttaaccggaacgttaacggaacctaaccggtaaacttaaacgtaaaaccttaacgtacgtggtaccgtacgtacgtaacccgtaacgtaatttaccggtacttaccgttacctaccgtttccccgtaaccgtacttaagttccgtaattacg

SEQ ID NO: 142554 - DNA, 723 bp, Homo sapiens
  misc_feature: GYAE6OF02HV02Q.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccgaaccggtggganacagtgtaccaccatctacgttcggccgggacaaggtacggaactagttacgaacctaaccttaaagttttaaaattggttaatacctaaaactaagtaaggaaccgaacggggaccggacccctaaacggtacctacctaaactactatacgtacgtagacctactaccgtagtttacgaacgtaaacggtcggggtacctaacgtcggaaggttcgaggtggactaggtacggtagtacggttgggaactaaggtactttactaccgtactaccgtaaccataaccgtaagttaaatccgtacggaactaacgtagtaaagttacttttaggaaccttaaactttaataacttacggtacaaaagacgtaaacttaactaagttacgtttacggacgaaacgggtactaaccggtaaactaaactaaaacgttaaacgaacttcggagtaccgtcggtaccaaccgttaatcgttacgttaacctcgttaacgttcccttaccccggtactacttccttagtaacc

SEQ ID NO: 142555 - DNA, 623 bp, Homo sapiens
  misc_feature: GYAE6OF02GCGZT.46.67.G01.1.454.CMB.1.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcggaanattgacacctatttaatgtatcaacatagaccgagggaccgcccctaagctcctatctatgctgcatccagtttgacgaaaggtcgggtacccagtcgaggttcagtggctagtggatcgtagggactaggtactttacacgttcctacacctactactaagttaactcgtagacctaacggtagtaagttattttagaccttaactttactttacgttagtacctaaactaagttaaattactaagtttcggttttacggaccgtaaagggtaccaacgtaacttaactaaaacttaaaccgtaacttcggtacgtacgtacgaccgtaacctattaccgttcgttaccttaccttacgttcccgtttaccccgtactacttcctagttaacc

SEQ ID NO: 142556 - DNA, 629 bp, Homo sapiens
  misc_feature: GYAE6OF02J0CBM.46.67.G01.1.454.CMB.1.raw
  modified_base (171)..(171): a, c, t, g, unknown or other
  misc_feature (171)..(171): n is a, c, g, or t
  modified_base (544)..(544): a, c, t, g, unknown or other
  misc_feature (544)..(544): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgttctcgtgggctgggtccgcagctcccgagggagggctaggaatacagttggaagttgtctctacagttaggtggtagttcctattacagttccgtctctacaagtcgtcgtagtacaccatatctcgtaggactacgtcagcaatctaacgtttccgagaatatgtacgttcgtgtaccgaccgccgtctacgtaccgtcgggttactttagttacgtgtcgacgagtacgacgtctagttatgttagtttaggagttgttactcgtacctacctagtacgtcggacgggtcctaccgacccggtagggaccgtaagggtactacgttcggtaccgtaccgtccgttaccgttaccnccgtaccgacccgacggtacccgtagttccccgttacccgtccccgtccgtaccctaccccttccaaccgtacgaccggtacccg

SEQ ID NO: 142557 - DNA, 693 bp, Homo sapiens
  misc_feature: GYAE6OF02GT4JW.46.67.G01.1.454.CMB.1.raw
  modified_base (215)..(215): a, c, t, g, unknown or other
  misc_feature (215)..(215): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttggagacccctgtcccctcacctgccgctgtctctggtcncctccatcagtagtgtttctcgtggggctgggtccgcagcctccgagggaagggctaggaatacgattggaagtgtctctcatagtggtacgttctattacagtccgtctctcgaagngtcgagtccaacattactcttcgtcggacctacgtacccaagctaaacttccttaacgttttcccaaggtaacgtagttcggtactttccttaggtcgaccccggtccgtacgttacgacggtaccgggttcttttaacgttacgtggttcggacggttacggacggtacgttctttaagtttacttacgggtttatttttaggggaacggttttggttttactttaccggtaaccttaccgtaaggtacgtccgggtaccggggtctacccgggtacccggtcgggtaccggaagggttaccgtacggttacgggtcctacccggttacccgtttacgttacccgtacccgtaacccgg

SEQ ID NO: 142558 - DNA, 577 bp, Homo sapiens
  misc_feature: GYAE6OF02FONBJ.46.67.G01.1.454.CMB.1.raw
  modified_base (153)..(153): a, c, t, g, unknown or other
  misc_feature (153)..(153): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcganctgacccagtctccatccctccctgtctgcaaccggtgggagatagtgtcaccatcacttgccgggcaagtcggacattgacacctatttaaagttgtatcaacatagacagggacggcccctaagcctcctaatctatgctgcatcctagtttgacgaaaggtggggtcccattcggaggttcgagtggcagtggatcgtgggacagtattcactctcacctatctagtaactctgacaagttagagtaattttacgactaactttaattaccttagtacaactagtaattaactaagttcgttttacggaccgtaagggaccaacgaactaactaaaagttaaacgtaacttgagtcgtaggcctaaccattcgtcttcctttacgacttcccgttaccccgtcctaacttcgtacgttaac

SEQ ID NO: 142559 - DNA, 625 bp, Homo sapiens
  misc_feature: GYAE6OF02JD895.46.67.G01.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctcgacccagtctccatccctccctgtctgccgaaccggtgggagacagtcgtcaccntcacttggccgggnaagtcggaacattcgacaccttaatttaaattggtactacgaacatacgaccgagggaccgcccctaagcctacctaattctatgctgcactcgtagtttagcgtaaaggtcggggtacctagtccggtaggttccgagttcggnaggtgatcgtaggacagtacttcactcncaccntacagtactctgtacaaggtntaaggttatttcgactaacttattactgtaacaagtaagtaacttaacgtaattcggttccggaaccggtaacggacgaacgttaacctaaactaaaagttaaaacccgagttacggtacgtcgtagacccgtactacgttaaccttgttacctttacgtaccgttcccgttacccgaaccgtactttacgtacttaaccg

SEQ ID NO: 142560 - DNA, 837 bp, Homo sapiens
  misc_feature: GYAE6OF02H80XY.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggacgacagtcgtacaaccgntcacgttcgggacccgggataaggtacggaacagttacggaccctaactttaaattttaaagttcggttaattaccgaaactaagttaacgaccgaaggggacccgaccccgtaagcctacccgtaatccttaatccgtcctagacctactaccgtagtttcgacggtaaacggttccggggtaccctagttccggtaggttcgacggtaggacgtaggtagggtacgtcggtacgggtacgtacggttaaacgtttccaaccgtttcgttaacccgacccgttaagttaccgtaaaggtttacttaccgtacgtaaccgttaaacgtaggttaaacgtttaacgtttacgtaaaccgtttacgttttaacttaaccgttacggttaaaccctaaagtaaacgtttaaacgtttaaccgtaacgttttacgggttttaacccggaaccggttaaacgggaaccgtaaccgtaaccgttaaaacgtaaaaccggtttaaacgaaacggtttacggtaacggttacccgtacggttaacccgaaccgttaacttccgttaaccgttactttaacccgttacgtttaccccggttcccttaaccggtacctttacggtaccgttaaccg

SEQ ID NO: 142561 - DNA, 687 bp, Homo sapiens
  misc_feature: GYAE6OF02JDXD8.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctcgtccctggtgcaactgcaggagtcgggcccagactggtgaggcccttggagaccctgtccctcacctgcgctgtctctgggtncctcatcagtgtggtttcttcgtggggctcgggtccgcagccgtacccgagggacgggcgtaggaatacgtagttggtaagtggtcctcgtacagttaggtacgggttaggttaccttattacgtaacgttcccgtactccgtacgtaagcggtaacgtacgttccaacctataacttacgtaccttggaacctacgtaccctaagactaacttacgtacgttttaccccgtaggaaacgtcgttagtacgtttcttcggtacgtacccggcgtcgtagtaaccggtacgggttcgttttaagtccgtagttccggtggtaacgacggtacgtactttagttatgtttaggtttgtagggttgtttaactcgaacctctaacgagttccgggacggtcctacccggcccgttagggccgtaacggaacgttcgtacggtaccgtaccgttaccgtccgttacgtacccgtacccg

SEQ ID NO: 142562 - DNA, 672 bp, Homo sapiens
  misc_feature: GYAE6OF02FRHT6.46.67.G01.1.454.CMB.1.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaccgtgggacccangtgtcacactcactggccgggnaagtcggaactattcgacctaccttaattttaaagttggtaatcaaacagtacgaccgaggggtaccgcccctaagccttacctaatctangctgctactccgtgtttacgacgtaaaggttcggggtcccagttccggaggtttccaggttggcgaggtggtactcggtagggtaacaggttatttcctacctctctaaccacttacgaagtttatacctgtaccaaggtagtaagttctttacgaccttaaactttacttacttacgtactaaacgtagtaaacttacgtattacgggttttacgaacccggtaaggtacctaaacggtaaccttaaaccgttaaaacgtttaaaccggtaacgttaccggtaggtacttccggaacctaaccggtattcccggttattaccgttcttaacgttcccttacccgtcgtaacttcgtataacg

SEQ ID NO: 142563 - DNA, 586 bp, Homo sapiens
  misc_feature: GYAE6OF02F9G1X.46.67.G01.1.454.CMB.1.raw
  modified_base (171)..(171): a, c, t, g, unknown or other
  misc_feature (171)..(171): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtgggctgggtccgcagctccgagggaagggctggaatacattggaagtgtctctcagtagtggaggttcctattacagtccgtcctcaagagtcgagtcaccatatctctggacacgtcagcaatctagtttccagaanatgagttngtgaccgcgctgacacggtctttatactgtcgcgagagacgactattagtgtatttggagttgttacttcgactaccgtagtacgtcggacggggtctccggtacccgtggggacctagggaacttacgtcggtacgtaaccgtcgttaccgttacgcccttaccgaaccgtaccgggtccctaacgttccggtcccttccccgtcgaccctacccttcccgtacaacgtacgaccctacccgg

SEQ ID NO: 142564 - DNA, 849 bp, Homo sapiens
  misc_feature: GYAE6OF02JUXAF.46.67.G01.1.454.CMB.1.raw
  modified_base (149)..(149): a, c, t, g, unknown or other
  misc_feature (149)..(149): n is a, c, g, or t
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (422)..(422): a, c, t, g, unknown or other
  misc_feature (422)..(422): n is a, c, g, or t
tcagactagcagtacacgaccggtgctcgatttagagtatacatattgggtttgtcctcctgctggtggcagctcccagatgggtcctgtccctggtgcaactgcaggagtcggccacgactggtgaggccttcggagaccctgtcccncacctggcgctgtcgtctggtcgcctccatcagtagttggtttcttcgtggggcttgggtccggcagtcctccgaggggagggctgggatacgagttggagttcgtctactcgaactagnggtacggttcctagttaccagttcgtctcgtcaacggngtacgagtcctaccagtactcgtcgtaggacctaaccgtcccgaaggcctaaacgttctaacggtttttcccaggtaacgacttgtaaacgttcttggtacgtaccgcccggttntacgtacggtacgggttccctttttaacttacgtcgggtttcgaccggtaagggaccgtaacccggggtaccttaaagtttacgttacggttaacggttttttggtaaccgggtttagggttttaaccgtttacgggttaaccctttaccccggttaaaggtacttacccggggtaaacgggggttccccgttaaccgggttcccccgggttagggggttacccgggtaacgggggttaaaccttaacgggtttccggttacccggttacccggttaacccgttccgtttaccgttaccccggttacccgtaacccgggtaaaccccggtcccgaacggtttcccgggttaaccccggttccccgttacccccggtttccgaaacccccgttttccctaccgggtacccgggtacccgttaacccgg

SEQ ID NO: 142565 - DNA, 624 bp, Homo sapiens
  misc_feature: GYAE6OF02HCOGL.46.67.G01.1.454.CMB.1.raw
  modified_base (578)..(578): a, c, t, g, unknown or other
  misc_feature (578)..(578): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaacgtcggaacattgactaccttatttaaattgtatcaacatagaccgagggaccgcccctagctacctaactctatgctgctactcctagtttcgacgtaaaggtcggggtccagtcggtagttcagtggctagtgatcgaggacagtacttcactctacactatactagtactcgtagacgtaacgtgtaaagttagtttagaccttaactttatttacgttacgttacaaacgtaacgtaaactttactaaggtttcgtttaaccggaccggtaaagggtacaaacgttaaccttaaaacgtaaaagtttaaaccgtaacgttaggtacgtaccttacgacctaccgtattaccgtnttaccttacgtacttcccgtaccccgtacttacgttcttacgtacg

SEQ ID NO: 142566 - DNA, 658 bp, Homo sapiens
  misc_feature: GYAE6OF02H11UY.46.67.G01.1.454.CMB.1.raw
  modified_base (463)..(463): a, c, t, g, unknown or other
  misc_feature (463)..(463): n is a, c, g, or t
  modified_base (503)..(503): a, c, t, g, unknown or other
  misc_feature (503)..(503): n is a, c, g, or t
  modified_base (604)..(604): a, c, t, g, unknown or other
  misc_feature (604)..(604): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtgggacacagtgtccactatcacttcggccgggtcaaaggtcggaaacctagttcgacctaccgtttaatttaaacgttggtaactacaactaataacgaccgtaacgggaccggtaccccctaaaggtaccttaccctaaattacgttaatcgacttacggcctaactcccgtagttttccgaacgtaaagggtcgggtaccccaagttcggagtttccggaagtggcaggtcggatcgtaggacagtactttcaacttctacacactctaactanctacactaaacgtagtaacgttatttacgacctaaatttnttaacgtcgtacaacgtaagttaaataacgttacgttgtttaccgagaacggaactacgtaactaactaaaacttaaacgactaggtctacgtaccgtacnctaacgttcttacgtactattacgttacccgtccttaccgatttccgagttaac

SEQ ID NO: 142567 - DNA, 748 bp, Homo sapiens
  misc_feature: GYAE6OF02GY4Q6.46.67.G01.1.454.CMB.1.raw
  modified_base (173)..(173): a, c, t, g, unknown or other
  misc_feature (173)..(173): n is a, c, g, or t
  modified_base (209)..(209): a, c, t, g, unknown or other
  misc_feature (209)..(209): n is a, c, g, or t
  modified_base (292)..(292): a, c, t, g, unknown or other
  misc_feature (292)..(292): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctcgtggtncctcatcagtagttgttctcgtgggctcgggtccgnacgctccgagggaacggctaggaatacagtggaagtcgtctctcagttaggtaggtagttcctattacgtcgtccgtctctanaagtgtacgagtaccactatactcctcgtacgactaccgtcaagcctaacttcgtaccgttttcccaagtaacgtagttcgtaacgtttctacgttccggaacccgtcccgacgttacggtaacccggtacggggtttacttttacgttacgtcggtacgaacggtaggaacgggtaccgtagttaagtttacgttagtttaggtttttagggaacggttttacgtttacgtttacccggaacccttaaccggttaaggtccggtaacggggtaccggggtcccttcccggggtaaccccggtaggggacccgtaagggtacgttaacggtccggttaccgtacccgttcgtaccttaccggccccttaacgaacccggtaccggtaccctacggttcccgttaccccgttcccgtacccgccctaacccgtccctaacggaccgcgtaaccccgg

SEQ ID NO: 142568 - DNA, 626 bp, Homo sapiens
  misc_feature: GYAE6OF02G6ST7.46.67.G01.1.454.CMB.1.raw
  modified_base (253)..(253): a, c, t, g, unknown or other
  misc_feature (253)..(253): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagttggtttctcgtggggctgggtccggcngcctcccgagggaaggggctggaatacattggaagtgtctctcataggtggacggttcctattacagtccgtctctcaagcgtcgagtccaccatactcctctggacaccgttaccagcaatctacgttttcccagtaagtactgtagttctagtcgaccgccgcgtcgacgtacgggttntttatacgtgtgacgagacgacggtactagttatggttagtttttggaggtttaggtttagtttaccgaaccgttaccgttaagtacgttccgggaccggggtcctacccggtcccgggtacgggacccgaagggttaacctacggtcgttacccgaccgttcccgttaccgttaccgtcccgtaaccccgg

SEQ ID NO: 142569 - DNA, 681 bp, Homo sapiens
  misc_feature: GYAE6OF02G4MGM.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtcccggcagcctcccgaggggaaggggctgggaatacagttggaagtgtctctcataggtgggacggttcctattacagtccgtctctcaagagtcgagtccaccatatctcgtggacacgtccagacaatctacgttttcccagaacgtatgtacgttctgtcgaccgccgctagaccgtacgggtcgttttattacgtgtaggcgagacggcggtacttagttagttgttacgttttagggaggttaggtttactttaccggacctaacccgttagacgtaccggggacgggggtcctacccgggtaccccggtaggggacccggaaggggtaactaccggttacggtccgtacccgttccgttacccgttacggtccctacccgaccggaaccgggtacccgtacgttcccggttcccctttcccccggtaccggtcccctaccccgttaccctacccgagtcccgtaccccg

SEQ ID NO: 142570 - DNA, 673 bp, Homo sapiens
  misc_feature: GYAE6OF02GQSTT.46.67.G01.1.454.CMB.1.raw
  modified_base (289)..(289): a, c, t, g, unknown or other
  misc_feature (289)..(289): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctcatcagtagtggtttcttcgtgggctgggtccgcagctcccgaggggaagggctaggaatacagttggaagtgtctctcatagtggagttcctattacagtccgtctctcaagngtcgatcaccatactctctgacacgtccagcaatctagtttccctagaagtntgtattctgtcgaccgccgataggacgtcggtacgttttacttacgtggtgaccggagacggtaacggtcttaagtttaacgtagtttagtttttacggggtaggttttacgggtttaagtttccggaaccgtacccgttaggtaaccgttacgggaccgggggtccttacccggaccccggttggggacccgtaggggtaacttcggtcggtcctaccggttccttcccgttacgtcccttaccgaacccgtaaccgggccctacggttacccggtcccctttaccccggtcggtccctacccccgttccgaaccgtaccgaccgtacccg

SEQ ID NO: 142571 - DNA, 679 bp, Homo sapiens
  misc_feature: GYAE6OF02GW6ED.46.67.G01.1.454.CMB.1.raw
  modified_base (208)..(208): a, c, t, g, unknown or other
  misc_feature (208)..(208): n is a, c, g, or t
  modified_base (314)..(314): a, c, t, g, unknown or other
  misc_feature (314)..(314): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctcccgagggaagggctaggaatactagttcggaagtgtctcgtcagtagtggagttcctatacagtccgtctctgagagtcgagtcacatatctcgtggaacnccgtcagacaagtctacgtttcccagaacatgtagttctgtacgaccgcgtctagaccgtacggggttctttaactacgtgtcgtacgaggtaacgacggtcttaagtttacgtggtttaagttttgggtaagtttggtttaactttaccggaaccttaacccgttacggtacgtacgggaccgggtaccgtaccggtaccccggtcgggaaccgtaacggggtaactcggttacggtacctaaccggtcccgtttacgtaccgtcccgttacccgaacggtaccggaccccgttagtaccccggttcccttcccccggtacgtcccgtacccccttaccggttacccgaacggtacctacccgg

SEQ ID NO: 142572 - DNA, 671 bp, Homo sapiens
  misc_feature: GYAE6OF02JJ83F.46.67.G01.1.454.CMB.1.raw
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
  modified_base (293)..(293): a, c, t, g, unknown or other
  misc_feature (293)..(293): n is a, c, g, or t
  modified_base (553)..(553): a, c, t, g, unknown or other
  misc_feature (553)..(553): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgacggtccttcggagaccctgtccctcacctgcgctgtctcgtggtcncctcatcagtgttgtttctcgtgggctcgggtccganacgcctccggaggggagggtctaggaatacgagttacggagttcgtactctacgtagtaggtggtacgttacctagttacncggttccgtctctagagtgtcgactaccactatctctcgtagacaccgtcagactaactcgttaccggttaccaggaacgtgtagtagtttcgcgtaccgaaccgtcggtacgtgtaaaccggtacgggtttctttaacggtgtacgtcggacgtaaggtacggtaccgttacttaattaggttacggtttagtttagggtacggttacgtttctaccgaccgttaccgtaagtcggtacgggcggtctaccggaccggngggtaccgagtacgtccgtagcctcgtacctcgtacctccaccgtaaccgaccggtcctcgtcccggttacccctccggttaccgcccttacccggtacctaacgtacgccctaccgg

SEQ ID NO: 142573 - DNA, 837 bp, Homo sapiens
  misc_feature: GYAE6OF02H8WM4.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgacggcctttcggacgtaccctcgtcccctcacccgtgccgcttgtcctctcgggtcgacccttccatccgtagttacggttcggttttcttccggtgggggccgttggggttcccgcgacggtcccttacccggagggggaacggggtcgtagggaaacttaccgaggttttaggaacggttcgtccttcgtaactaagttaggtacgggtaccgttttaccctttaagtttaccgacggttacccgttccttaccgtacgtaaaggtacgtacggtaacgttcccaacctacttacttccgttcggtacggtaccctaccgtacccaagaccgttaaacttccgtttaccgtttacccgtaagaaacggttagtttacgggtacttttccgtggttacccgaccccggtaccgtcgttacggtaaccgtaccgggtttacgttttacgttacgttcggttcggaacggtacggtaaccgggcgttaacgttagtttacgttagtttacggtttttaggaggtttacggtttcgtttacctaaccgtaccgttagtaccggtccggaccggggttccgtcccggtaccgggtacgggtaccgtaacggttaccgtacgttccggtacctacccggttccctacccgtttaccgcccgttaaccccgg

SEQ ID NO: 142574 - DNA, 703 bp, Homo sapiens
  misc_feature: GYAE6OF02HSV7N.46.67.G01.1.454.CMB.1.raw
  modified_base (275)..(275): a, c, t, g, unknown or other
  misc_feature (275)..(275): n is a, c, g, or t
  modified_base (677)..(677): a, c, t, g, unknown or other
  misc_feature (677)..(677): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctccctgtctgacaaccggtgggacgacgagtgtcaccatctacgttggccggacaagtacggaactattacgaacctaccttaatttaaattggtaatacaanactacgaccgtagggaccgacccctaagccttacctaataccttatcgctcgtcctacttacctagtttacgaacgtaacgggttccggggttaccctagggtttccgggttacagggttgcgtaaggttcggtagttcgggtagggactaagttactttaccaacgtcctaccgaactactacgtacgtactctacgtactaacggtataaggttactttacgaacttaacgttttattacgtacgttaacaaccgttaagttaaaccttaacgttagtttaccgttaccggaaccgtaaaggtacctaaccgtaaaccttaaacgtaaaagttaccgaagttacgggttacgtactacgacctaacgtccttacgttactaccgttacttccgttacccnccgtacctattacgtattaccttacg

SEQ ID NO: 142575 - DNA, 582 bp, Homo sapiens
  misc_feature: GYAE6OF02G4SCH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagcctcctaatctatgctgcactccagtttgactaaaggtcggggtcccagtcgaggttcagtggcagtggatcgtgggacagatttcgactctacaccatcagtatctagacaacgtgaagtatttgactaacttattactgtacaactagtaattactaattcgttttacggaccgtaagggtacaacgtaactaacctaaaagtttaaaccgaagttgtacgggtacctacgtaccaaccgtattccttagttccctttactaccgtttcccttacccgaccttaacgttccttacggttaacc

SEQ ID NO: 142576 - DNA, 702 bp, Homo sapiens
  misc_feature: GYAE6OF02GK2XG.46.67.G01.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcaccatcacttggccggganaagtcgaacattgacacttaattaattgtatcaacatagacgagggaccgacccctaagctacctaatctatcgctgacactcctagtttcgacgtaaacggtcgggtacccagtcggtacggttcgaggtcggacgtaggtggacgtcgtagggaactagtaactttcactctcgacatactagtacttcgtacgacgtaacggttagtaagttattttacggaacgttaaaccttttaatttaaccgttcgtaacctaaacgtaacgttaaactttaaacgtaacgttttacgggtttaaccggaacgtaaacggggtaacctaaacggtaaccgttaaaacgtaaaacggtttaaaaccgtaaccgtttacggtaacgggtaccttacgggtaaccctaacgttaacttaccgtttacgttaccgtttacctaccgtttaccccgttcccggaacccttacgtttaccgtagttaacccg

SEQ ID NO: 142577 - DNA, 764 bp, Homo sapiens
  misc_feature: GYAE6OF02JUZSX.46.67.G01.1.454.CMB.1.raw
  modified_base (196)..(196): a, c, t, g, unknown or other
  misc_feature (196)..(196): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatcgtgacagtcgagctgacccagtctccagtcctccctgtctgaccaaccgtgganactagtgtcctaccatcgacttgccgggtacaacggtcggaacctagttcggaacctacccttaattttaaaagtggttaactaccgtaaactacgttaagacccgaagggtacccggaccccgttaaaggccctaccttaaactacgtaacttcgaccgtgtaccacgtcctagtttccgaacgtaacggtcggggtacccagttacggtaggttcaggtcggcacgggttagattaccggtgggaactacggttattccgtattccgactacctaatcgtataactcgtacgtaacgtaaccggtntaaacgttcgtttacgaccgtttaaacttttaacggtacgttacggttaaacaaaccgttaacgtaaacgtttaccttaagtttacggtttaacggtaacccgtaaaggggtaccctaaaccgggttaaacttaaaccgtaaaccggtttaaaaccgaacgtttaccgggaagttcccgtaacgtaccgtaaaccgtacttacgtacgtttactaaccgtacctttccgttaaccccgtataacccttagtacttaaccg

SEQ ID NO: 142578 - DNA, 775 bp, Homo sapiens
  misc_feature: GYAE6OF02I0RPL.46.67.G01.1.454.CMB.1.raw
  modified_base (128)..(128): a, c, t, g, unknown or other
  misc_feature (128)..(128): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtnaggccttcggagaccctgtccctcacctgccgctgtctctggtgcctccatcagtagtgtttcttcgtgggctgggtcgcagctcccgagggagggctggaatcagttggaagttgctctacagttacggtggagtttcctattacgagttccgtctctacaagagtccgagtcacctatactctcgtggaaccacgttccacgactaaacttcgtaacgtttttccccgagtaacggattacggtacgtttcttcggttacggaacccggtccgtcgttagtaccgtacgggtacgtttttacgttaacgttcggtaggacgtacgaacggtacggaccttaatttagtagtttaacggttttgggaacgtttggtttaacgttacggtaacctacccgttaagggtacgttaccgggtacggggtacccgttacccggacccggttacggggtacccgtaaggggaaaccgttttacgtacgggtttcccgaaacccggtttcccgtttaccgttaacccgggtcccttaacccggtaacccgtaacccggggtacccttacggtacccgggtttcccccgtttaccccgttaacgggtcccccgtaccccttacccggtaacccgtaacggtccccgtaacccg

SEQ ID NO: 142579 - DNA, 893 bp, Homo sapiens
  misc_feature: GYAE6OF02H83JF.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtccctgtccctggtgcaactgcaggagtccgggcccacgactggtgaggccttcggagaccctgtccctcacctgcgctgtctctggtgcctccatcagtagtggtttcttcgtgggctgggtccggnagcctccgagggacgggctaggatacagttggagtgtctcgacgattaggtgtacggttcctagtacgtacgttccggtactcgtacgtaaggagtcgacgtaccaccgtataacgttccgtcgtacggaccgtaccggtaccaacggtacctaaacttccgttaacggtttttccccgtaaggtaagtaccttgggttaaccttttcggttacgtcccgggtaacccggtcccgttaacccgtcgggtaaacccggtacccgggggtttaacgtttttttaaaccgttaccggtttagggtaaccggtaaccggtacggtaacggggtaaccggtttaaccgtttaaagttttacgtttcggggttttaaagttttttaccgggttaagggttttaaccgggttttttaacgtttacccgggttaacccttaaccccgggttaacggtaccggggttacccgggtaaccggggttccggtaccccggttaccccggggtacgggtaacccggggtaaggtaaccgtaccgtcggttcccgtaacccggttcttaaccgtaccctcccgtaacccgaaccgggtaccgggtccctacggttaccccggttacccgtttccccccggaccggttacccccttaccccgttaaccctccggtaaaccggcccttaaccccggg

SEQ ID NO: 142580 - DNA, 653 bp, Homo sapiens
  misc_feature: GYAE6OF02GC76X.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatccagtagtggtttctctggggctgggtccgcagctcccgagggagggctaggaatacattggagtgtctctcatagtggacggttctattacacgtccgtctctcaagagtcgagtcacatatctctggacacgtccagcaatctacgtttccctgaagtgtgacgtttctcgtcgaccgccgtcttcgaccgtacgggtcttttaactcgttggtagtaccgaggtaacggacgggtcttagtttacgtaggtttacgtttttagggtaggtttggttttactttaccgtacctaccccgttaagtacgttacccgggtacgggggtcccgttaccggtacccccggttacggggacccgtaaaggggtaacgttacggttcgggttacccgtaacccggttccgtttacccgttaccgtccccgtaaccccgg

SEQ ID NO: 142581 - DNA, 735 bp, Homo sapiens
  misc_feature: GYAE6OF02IHA4R.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcgggacgacccctgtcccctcacctgccgctgtctctggtcgccctccatcagtagttgtttcttcgtggggctgggtcccggacgcctcccgaggggacgggcgtaggaatacgtattaggagtgtctctcagtaggtggacggtttcctattacgagttcccgtcttctacgaagtacgtcgacgtccacctatactcttacgtacggacctaccgtccagtactaaacttccttacgttttcccaggaacgtagttcggtacgtttacgtcggttaccgccccgtaccggtcctcggtaaccgacggggttaccttttacgttacgttcgttacgacggtagtaacggccggttattagttacgttaggtttacgtttttgggtaagttttcggtttaagtttccgacccgtacctaggtacgtaccggggtacggggttacccgttcccgggtaacccggttaccggggaccggtaaccggggtaaacgtttccggtacggttcccggttaaccccgttccgtttaccccttaccgggtcccccttaaccccggg

SEQ ID NO: 142582 - DNA, 618 bp, Homo sapiens
  misc_feature: GYAE6OF02GXGDY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccggcccctaagcctctaatctatgctgcatcctagtttgacaaagggtcgggtcccagtcggtaggttcaggtggcgagtggatcggtagggacagtactttcacttctcacctataccaagttaactccgtagacgtaacgtaggtaaagttattttacgacttaaactttattacgttacgtaacaaactaagtaaacttaacgtaagtttcgtttaccggaccgtaaagggtaccaaacgtaaccttaaacgtaaaacgttaaaccgaacgttggtacggtactacgaccgtaacctacgttcttacgttccttaccgtacttcccttacccgacctatcctagtac

SEQ ID NO: 142583 - DNA, 692 bp, Homo sapiens
  misc_feature: GYAE6OF02GUBUM.46.67.G01.1.454.CMB.1.raw
  modified_base (171)..(171): a, c, t, g, unknown or other
  misc_feature (171)..(171): n is a, c, g, or t
  modified_base (290)..(290): a, c, t, g, unknown or other
  misc_feature (290)..(290): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccgcagcctccgagggagggctaggaatacagttggaagttgtctctacataggtggaggttcctattacagtccgtctctcaagngtcgagtccaccatactctcgtggacacgtcagcatctacgtttccagaagtatgacgttctgtcgaccgcncgtcggacgtaccggggttacttttagtacgttggtacgacggaggtacgaccgggtactttaagtttaagttgttaacgtttttagggtaggtttacgggttttactttaccggaacccttaacccgttagaaccgttacggggtaccgggggtacctcccgggaccccggttcgggggacccgaaggggtacttaccggtcggttacccgtaccgttaccttcccgttaacgtaccccgtaccgtaaccggaacccgggacccgtaccgttacccggttcccttccccggtcgtccccgtacccctacccgtaccacggtacgacccg

SEQ ID NO: 142584 - DNA, 841 bp, Homo sapiens
  misc_feature: GYAE6OF02FJDLI.46.67.G01.1.454.CMB.1.raw
  modified_base (100)..(100): a, c, t, g, unknown or other
  misc_feature (100)..(100): n is a, c, g, or t
  modified_base (238)..(238): a, c, t, g, unknown or other
  misc_feature (238)..(238): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttgggggacctcctgtgcaagaacatgaagccacctgtggtttcgtccncctgctcggtggcagcctacccagactcgggtcctgtaccctggtgcaactgcaggacgtccgggacccagtactgggtacacggcccttagggacacccctgtcccctcaccctgccgtctcgtcctcgtgggtacnccctaccacttcgaggttacgttcggtttcctccgtcggggccttcggggtaccgcagcctacccggaggtacggtctcggtaactcgagttcggactcgtctacgctatcgnggtacgttctatacgcgtccgtacttcgtaacgacgtacgtccgacgtaccacctagtaccttccgtcgacggacctaccgtaccacgtactaactccgttacgtttacccgagtaacgcgttacgtacgtttccgtcgtacccgtccccgtaccggtccgtacggtaacggcccgggtttaacctttaacggtacccgttacgggtacgtaccggtaaccgggtaaccgtaccggttccgtttaaacgtttaggttacgtttaagggtttaccggtaacggttttaacgttaaccgtttaaccccgaaacccttacccgtaagggttaccccggttaaccgggaccccggggttacccgtaccccgggttaaaccccgggtcggggtaaacccccggttaaggtaacccggttacccgttaccggttaccccgttaaccccggtttccggttaacccccgttacccggttacccccgtaaaccccgggg

SEQ ID NO: 142585 - DNA, 803 bp, Homo sapiens
  misc_feature: GYAE6OF02HKTUX.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttcttcgtggggtctggggtcccggcgcgccgtccggaaggggagggtcgtaggtaactacgtaggttaggtaagttcgtccttctacgtaggttaggtaggggtacgttaccttacgttaccgtaccgttcccgttacttaccgtaacgaacggtggtaccgtacgtacctaacctagttacctcgtcgtacgaacctaccggtaccaacgaaccttaacgttaaccgttaccggttttcccgaaggtaacgttaggtttagttaccgtttacggtacggttacccgggaccccggtacccgtacggtaaccggtaaccgggtaccggggtttacgttttaacgttcggttacggttacggaccgggtaagggaccgttaacgggtactttaagtttagttcggttttaggtttgggttaggtttacggttttacgttaccgtaacccgtacgtacgtaccggtcggggtaccggggtccctacccgggtcccgggtacggggaccgtaagggtaaccgttcggtaccggtaccgttacccgttccgttaccgttccgtacccctaacccgg

SEQ ID NO: 142586 - DNA, 625 bp, Homo sapiens
  misc_feature: GYAE6OF02FOYBC.46.67.G01.1.454.CMB.1.raw
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacattggaagtgtctctcatagtggagttcctattacagtccgtctctcaagngtcgagtcacatatctctgacacgtccagcaatcacgttttccctagaagatgtagttctgtcgaccgctctgacgacggtcgtttattacgtgtgcgagaggacggtactattatgttagttttggagttggtttatttcgtactaccgtagtacgtcggacggggtcgtccggtacccgtacggggccgaagggtactacgttcggtaccgtaccgttccgtaccgttaccgtccctacccgaaccggtaaccgggacccctacggttcccggttccccgttccccccgtcggtaccccgtaccccgttcccctacccgtaacgccgtaaccccg

SEQ ID NO: 142587 - DNA, 650 bp, Homo sapiens
  misc_feature: GYAE6OF02HUXRJ.46.67.G01.1.454.CMB.1.raw
  modified_base (285)..(285): a, c, t, g, unknown or other
  misc_feature (285)..(285): n is a, c, g, or t
  modified_base (330)..(330): a, c, t, g, unknown or other
  misc_feature (330)..(330): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgagggaacgggctggaatacattggaatgtctctcatagtggagttcctattacagtccgtctctcgaangtcgagtcaccatatctctggacacgtccagcaatcacgtttccngaagatcgagttctggtcgaccgcgtactacggacgtaacgggtcgttttattacgtaggtcggacgagacggaccggtacttaagttacttgttagtttttggagtttaggttatttaccggactaaccgtagtacgtacggacggggtactccgaacccggtggggacctaagggtaacgttaccgtacggtcctacccgtaccgttaccgttacgtccctaccgaacccggaacgggtacccttaacggtcccggttcccgttacccccgttaggaccccttacccccgtacccttaacccgaaccgacgtaacccg

SEQ ID NO: 142588 - DNA, 715 bp, Homo sapiens
  misc_feature: GYAE6OF02GP19J.46.67.G01.1.454.CMB.1.raw
  modified_base (222)..(222): a, c, t, g, unknown or other
  misc_feature (222)..(222): n is a, c, g, or t
  modified_base (390)..(390): a, c, t, g, unknown or other
  misc_feature (390)..(390): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtcgtccacatctacgttcgccggganaaggtaccgaactatgactaccttaagttaaattgtatcaaacatacgacgagggtaccggcccctaaagcctacgtaatactaactgctacgctaacgttcctaggttttgaacgtaaacggtcggggttaccccaagtcggtaaggttcaggttggactaggtggntacgtggacagtacttacacgtctacgtacctaagtactaagtaactctacgacgtaacgtacgttaaagtacgtttacgtaaccttaaatttacgtttaactacggtaacctaaacgtaaaccgttaaaactttaaacgtttaaacgttaacggtttttaccgggaaacggtaaccgggtaaacgtaaccgtaaccgttaaaactaaaacggttaaacgtaaacgtacgtcgtacgtaacgacctaaccgtacttacgttacttacccgttaacttaccgttacccgttcccggtaaacctaccggtttacacggtttaaaccg

SEQ ID NO: 142589 - DNA, 1014 bp, Homo sapiens
  misc_feature: GYAE6OF02HZQ9V.46.67.G01.1.454.CMB.1.raw
tcagactagcagtacacgaccggtgctcgatttagagtatacatattgggtttggggagtctcggtcaggacacagcatggacatggagggtccccgctcagctcctggggctcctgctactctggctcgaggtcgccagatgtgacatcgagctgacccagtctccatcctcctgtctgcaaccggtggacgactagtgtaccactatctacttcggaccgggactaacggtccggtaaactagtttacggaacctaaccgttaaagttttaaacgttcggggtaacttaccgtaaacgtaacgttaacggaacccggtaacgggggtacccggtaacccccgttaaaaggtcccgttacccgttaaaacgttccgttaaagttcggtaccgttcggtaacccttaacgttaccccggttaaggttttacggaaccggttaaaacggggtttccgggggttacccccttaaaggttccggggtaaaccgggtttaccgtaagggttaccgggtaacccggttagggttaaccgggtaccgttaccgggttacgggggtaaccgttaacggggtttaaccttttacccgaaccgtttcccgtaaaccgtaacccgttaagttaccccgttaaaggtttaaccgttaccggtaacggtaaccccgttaaacgggttacggttaaacggtttaacgtttttacgaacccgttttaaaaccgttttaccgtttaaacggttaacccggtttaaacgtaaacccgttaaacggttaaaccgtttaaaccgtaacggttttaccgggttttaaacccggggaaccggttaaacccggggtaaccctaaaccggttaacccgttaaaccgttaaaaaccggtttaaaaccggtaaccgtttaacgggttacggttaccgttaccggtaaccctaaccggttaaccgttacgtttaaccggttacctttaaccgtaccgtttacccggtacccgtaacgtaccgttacggtacgttaaccg

SEQ ID NO: 142590 - DNA, 652 bp, Homo sapiens
  misc_feature: GYAE6OF02GRPFB.46.67.G01.1.454.CMB.1.raw
  modified_base (213)..(213): a, c, t, g, unknown or other
  misc_feature (213)..(213): n is a, c, g, or t
  modified_base (249)..(250): a, c, t, g, unknown or other
  misc_feature (249)..(250): n is a, c, g, or t
  modified_base (290)..(290): a, c, t, g, unknown or other
  misc_feature (290)..(290): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtcccctcacctgcgctgtctctggtncctcatcagtgttgtttctcgtggggctgggtccgnngctccgagggagggctggatactagttggaagttgtcctntcataggtagtcggttctattacacgtcgtctcttcaagtacgtcgtacgtccacgtatacttctcgtacgggacaccgtaccaggacaagtctacgttttcccagaacgtataggtacgttcgtagtcgtaccggccgtacgtcggaccgtacgggttctttaacgtacgttggtacgcgtagagacggtctaagttctagttagtttggtagtttcggtttaattccggtaactacccgtaagtacgtaccgggtaccggggtctacccgggaccccggttgggacccggttaagggtaccgttacccggttaggtaccacccgggttacccttaccggttacgtccccttaaccccggg

SEQ ID NO: 142591 - DNA, 917 bp, Homo sapiens
  misc_feature: GYAE6OF02JNC1T.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccctagtcctccatccctccctgtctgaccaaccgtggganacagtcgtcacctatcacttcggccggactaaggtcggaacacttcgaacctaccttaatttaaattggtatacaactatagaccgtaagggaccggtccccgtaacgccttacctaacttacgttaactcggtacctacgtacctaaccgttaccttacggtttacggaccgtaaaacgggttccgggggttacccctaacgtacgggttaacggttcgtaacggttcgggaccgtaagggttaggggtaaccttcgggtacggggtacgtaacgttacgtttaccgtaacgtttccgtaccctaacctacgtaacctaaacggtttaaacctacggttaccggtaaccgttaaacgggttaacggtaaacggtttaacttttaggtaaacccttaaaccgttttaactttaacccgttacgttaaaccgtaaacgtttaaacggtaaacttttaaaccgttaaagttttcccgggttttaaacccgggtaaccggtaaaccggggtttaaccctaaaccgggttaaaccctttaaaaagttaaaaaccccttttaaaaacgggttaaacccgtttagggtaaccgtaaccggttaaccgtacttaaccccgttaatttaacccggtttaccgtttacccgtttaacccggttaaccctttttaccccggttaccccctaacccgtttaaccggttttaccgtaaccgttttaacccgg

SEQ ID NO: 142592 - DNA, 858 bp, Homo sapiens
  misc_feature: GYAE6OF02INF2W.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcaccgtgcgctcgtctcgtggtcgcctcatcaggttagttcggtttctcggtcggggtcgttcggggtccgcacgtcccgtaccggaagggggaacggggtcgtacgggtaactaaccgtaggttacggtaaggttcggttacctacgtactaagttacggtacgggttaaccggtttaccttaacgttaacgtaccggttcccgttaccttaccgtaacgtaaacggtacggttacggtaacgtaccaaccgttaagttactccgttacgtacggaaccgttaccgtaccaacgtacttaacttaccgtttaaccgttttaccgaaggtaacgtaagttacggttacgtttcgtacggtaccggtaccccggtaccgtacggtaccggtaccggtaacgggtttaaccgttttaacgttaccggttcgggtaacggtacggtaaagggtaaccgggtaacgttaacgtttaagtttagtacggtttttaaggtttttacggggtaggttttacgttttaacgtttaccgaacccgttaaccgtaggtaaccggtaccggggtaccgggtccgtaccccgggtaacccgggtacgggaccggtaacggtaacgttcggtcggtaacccgtccgttaccgttacccgtaccggtacccgtaacccgg

SEQ ID NO: 142593 - DNA, 574 bp, Homo sapiens
  misc_feature: GYAE6OF02JKD2Z.46.67.G01.1.454.CMB.1.raw
  modified_base (497)..(497): a, c, t, g, unknown or other
  misc_feature (497)..(497): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccgagggagggctggaatacattggaagtgtctctcatagtggtaggttcctattacagtccgtactctcaagagtcgagtcaccatatctactggacacgtcagctatctacgttttcccagaagatagagttctgtcgaccgccgctgacgtacgggtctttatctgtgcgagagacgctattgtgtagttttggagttaggttattacgtactacctagtagtcggtacggggtcctccgtacccggtgggtaccgagggtaacgtacgttcggtaccnccgtcctcgtacgcctaccaccgaacggccctagtccgtaccttccccgtggccaccctcctaccacggtactcccg

SEQ ID NO: 142594 - DNA, 670 bp, Homo sapiens
  misc_feature: GYAE6OF02IWMGR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtgggagacagtgtcaccatcacttcggccggcaagtccggaactattcgactaccttatttaatcggtatcaacatacgaccgagggaccggccctaagcctcctaagtctagtgactgctagtcctagtttcgacgtaaacggttcgggtacccagtcggtaagggtttcaggttcggcgtaggtacggtaactccggttaggggaactaggttatttcccgaacttctaccgactagtctaagtacttcgacgtacgtaacgtgtaacgttgtttacgaccttaaacgttcttaacgtcgtaactaaactagtaaacttacgtaacgttggtttaccgaacgaacgggtacctaacgtaaccttaacgtaaaacttacggtaacgttcggtacgacgttaccgtaccaaccgtttacgtccggttacttcccgtaacttaccgttacccgttacccgacgtttaacgttacttcggtaaacc

SEQ ID NO: 142595 - DNA, 776 bp, Homo sapiens
  misc_feature: GYAE6OF02II2K7.46.67.G01.1.454.CMB.1.raw
  modified_base (264)..(264): a, c, t, g, unknown or other
  misc_feature (264)..(264): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtcgtcaccatctacttgccgggcaagtcggaactagttgactaccttaatttaaattggtataccaanatagaccaagggaccgacccctaagctcctaatctaatcgactgtaccatccgtagtttcgacgtaaaggttcgggtaccccagttcggtaggttctaggtggactagggtgcgtcgtggaactaggtactttcaacgtccttacgaacctacgttacgtaagtttaactccgtaatacgaaacggttagtaagttttaacgtttacggaccttaaactttttaagttacccgttaaggtacctaaaaccgttaaggttaaaactttacggttaaagtttacgggttttacccgggaaacgtaaacggggtaaacctaaaccggtaaacctttaaaaccgtaaaaaacgtttaaaaccgggttaaaccgttagggttaacgggtaccgtttaaccggtcccgtaaaaccgtttcgtttaaccggtttaaccgtttaccgttttaaacccttaccgtttcccccgtttttaaccccgggacccttttaacgttacccgttaaggttaaacccg

SEQ ID NO: 142596 - DNA, 569 bp, Homo sapiens
  misc_feature: GYAE6OF02I22ER.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatacgaccagggacgcccctaagctcctaatctatgctgcatccagtttgacaaaggtcgggtcccagtcgaggttcagtggcaggtggatcgtagggacagtactttcactctacacctatcagttaactctgacaacgtgaagttatttagctaacttattactactactaacaattaattactaagttggtttaccggaccgtaagggaactacgtaactaactaaaacttaaacgaactggtagtactacgtacctacctagttcttacgttcttacctactttcccgtacccacctacttacgtctaacg

SEQ ID NO: 142597 - DNA, 838 bp, Homo sapiens
  misc_feature: GYAE6OF02G32CA.46.67.G01.1.454.CMB.1.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (345)..(345): a, c, t, g, unknown or other
  misc_feature (345)..(345): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtgcctccatcagtgttgtttctcgtgggctgggtccgcngctccgngggagggctggatacgatggagtgtctctctagtaggtgggacggttaccttaatttaccgacggtcccgttacttcgtactaaacggngtacgtacgttaccaacctaatattaccgttcgtacggtactaaccgttacccgaaggtctaaacgttaccgttaccgttttttacccgaggtaaacgttcgttacggttacgttttccgttacggtaccggtaaccccggtcccggtacgttaccgggaaccgttacccgggggtttaacgtttttaccgtttaacgttcgggtacggtaccggtacgggaacgggttacggttacgtttaacgtttacggtttaggtttaggtttttttagggggtacggttttttaacgggttttacgttttaacccggtaacccgtttaacccgtaaggttacccgggttaccgggggttacccggggtcccgttaccccggggtacccccggggttacgggggtaacccggtacgggtttaaaccggttaccggttaccgggtacccgttaaccgttccccggtttaaccggtttacccgacccccggttaaccccgg

SEQ ID NO: 142598 - DNA, 719 bp, Homo sapiens
  misc_feature: GYAE6OF02FRLI7.46.67.G01.1.454.CMB.1.raw
  modified_base (322)..(322): a, c, t, g, unknown or other
  misc_feature (322)..(322): n is a, c, g, or t
tcagactagcagtacacgaccggtgctcgatttagagtatacatattgggtttgtcctcctgctggtggcagctcccccagatgggtcctgtccctggtacaactgcaggagtcgggcccacgactggtgaggccttcggagaccctgtccctcacctgcgctgtctctggtgcctccatcagtagtggtttcttcgtggggctgggtccgcagcctccgagggaagggctggaatacagttggaagtgtctctcataggtggtaggttcctaatttacagtccgttctctcaaggagtcgagtcacctatatctctggacncgtccagcaatctacgttttcccaggaacgtatcgtagtttcgtgtacgacccgccgtcgtacggaaccggtacggggttaccttttagttacgttggttacgcggaggtaacgaaccgggtctttagttaacgttggtttagtttttcggggacgtttagggtttactttaccggaccttaacccgttaggtacgtcccggggacggggtcccgtaccggtaccccgggttgggggtacaacggggtaactacggttccggtaccgtacccgttccttaccgttaaccgtcccgtaccgaaccgtaccgggtccctacggttacccggttcccttacccccggtcgtaccctacccccgttcccgttaacgaccggtaccgtcccgttaccccggg

SEQ ID NO: 142599 - DNA, 719 bp, Homo sapiens
  misc_feature: GYAE6OF02F43RF.46.67.G01.1.454.CMB.1.raw
  modified_base (263)..(263): a, c, t, g, unknown or other
  misc_feature (263)..(263): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattggggtttgggggacctcctgtgcaagaacatgaagcacctgtggtttgtcctcctgctggtggcagctcccagatgggtcctgtccctggtgcaactgcaggagtccgggcccagactggtcgaggcctttcgggacgaccccttgtcccctcaccttgccgtctgtctcgtggtcacctcatcagtagttcgtttctcgtggggctgggccggangcctccgagggaggctaggatacagttaggagtgtactctacgtagtaggtggtacgttcctagttacgacgtccgtctctacgaagngtacgagtcactatatctacgtcgactcgtccagactaatcttacgttttaccagtaaggtactaggttacgttacgtggtacgtacccggccgtacgtacggaacggtaccgggtttacgtttaacgttaccgttaggtcggtacgtacggtacgtccggtaactttaggtttagttaagtttagttttcgggtaggtttttacggtttacgtttaaccgaacttaacccggtagtaccggtaccggggtacggggtacccgttaccgggaaccccgggttggggaaccggtaaggttaaaccgttacggttccggtaacccggtttacccgttccggttacccgtttaccggtaccctaaccccgg

SEQ ID NO: 142600 - DNA, 712 bp, Homo sapiens
  misc_feature: GYAE6OF02IDL0G.46.67.G01.1.454.CMB.1.raw
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctggggctgggtccgcagctccgaagggacgggctaggaatacattggaagtgtctctcatagtggagttcctatacagtccgtctctacaagagtcgagtcaccatatctcgtggacactccagcaatctacgttttaccngaanacgtagtgttcngttacgaccgtacgcgtacgacgtaacgggtacgtttttaacgttacgtagtcgtacgaaggtacgtaaccggtactttaattaagttgttaacggtttttgggtaacggttaggtttaacgttttacggaaacctaacccgttaaggtaaccgttaccggggtaaccggggtccttacccggtaaccccggtacgggggacccgtaaacggggtaaacgttaaccgttccggttacccgtaaccgttcccttacccgttagaccccgttacccgtaaccggaaacgggtaccctacggttccccggttaccttcccccgtacggtccctaaccccgttaccctaccgaacgtacgtacccgg

SEQ ID NO: 142601 - DNA, 871 bp, Homo sapiens
  misc_feature: GYAE6OF02G4EN3.46.67.G01.1.454.CMB.1.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtgttggtttctcgtgggctgggtccgnagcctcccgaggggacgggctaggaactacgtagttaggaagtcgttacctcgtactaagttaggttagggtaacgggtttcccttaagtttaaccgtacggttcccggttacttccgttacgaaacgggtacgttccggacgttaccaaccctaattacgttaccgttcgtacgggaacctaccggtaccaaggtacctaaacgttccttaacggtttttacccaagggtaaaggtactttacggtacggttttactcgggtaccggtaccccgggtcccggtaccgttacggtaaaccgggttaaccggggttacgtttttaaacgttacgttcggggttacgtaccggggtaaggtaacgggtaacccgggttactttaacgttttagttagggttttaacggttttttaggggtacggttttacggtttttaacgttttccggtaaacccgttacccgttaaggttaccggttacccggggacccggggggttccgttaaccccgggtaacccccggggttaggggtaaccccggtaacggggtaaccgtttaaccggttccgggttacccgtacccggtttacccgtttacccgtttacccgggaccccttaaccccgg

SEQ ID NO: 142602 - DNA, 549 bp, Homo sapiens
  misc_feature: GYAE6OF02HDTES.46.67.G01.1.454.CMB.1.raw
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacagttggaagtgtctctcataggtggaggttcctattacagtccgtctctcaagagtcgagtcaccatatctctggacacgtccagcaatcagttttccccngaagntgagttctgtgaccgccgctcgacacgggtcttttattactgtgcgagagacgctattatgtattttggagttggttatttcgactacctagatcggaggggctcgcccgtgggccagggaactactgggtccaccgtctcctagccctccaccgacggcccagtccgtccttccccgngcccnccctccctaccacgactaccg

SEQ ID NO: 142603 - DNA, 764 bp, Homo sapiens
  misc_feature: GYAE6OF02GVCFO.46.67.G01.1.454.CMB.1.raw
  modified_base (149)..(149): a, c, t, g, unknown or other
  misc_feature (149)..(149): n is a, c, g, or t
  modified_base (180)..(180): a, c, t, g, unknown or other
  misc_feature (180)..(180): n is a, c, g, or t
  modified_base (215)..(215): a, c, t, g, unknown or other
  misc_feature (215)..(215): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggngtcgggcccacgactggtgaggccttcgganaccctgtccctcacctgccgctgtcctcgtggtcncctccatcagtgtgtttctcgtgggctgggtccgcagtcctccgaggggagggctaggaatacgagttggaagtgtctctcagtagtgggtacgttcctattacgcgtccgtctactcgaagacgtcgacgtacaacctagtacttccgtacgtacggactaccgtaccaggtacctaattccgtacgtttttacccaggtaacgtattcggtaagtttcctggtaccgtacccgccgtaccgtaggaaccggttacgggtaccgtttttaacttaccggttaggttaccggtacggtacggaacggtaccggttagtttaagttaacttgggttttaaggttttttcgggaagttttacggttttaacgtttacccgaaaccttaccccggttaagtaccggttccggggtacccgggggttaccgttaccccgggtaacccgggttccgggggaccggttaaacggggtaaccgtttaccggtcccgggttaacccgttaccccgtttaccgttaccccggtttaccggacccccttaacccccggg

SEQ ID NO: 142604 - DNA, 654 bp, Homo sapiens
  misc_feature: GYAE6OF02FRWDA.46.67.G01.1.454.CMB.1.raw
  modified_base (256)..(256): a, c, t, g, unknown or other
  misc_feature (256)..(256): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctggggtccggcagctcccgaggggaaggggctggaatacattgggaatgtctctnatagtggaggttcctattacagtccgtctctcaagagtcgacgtcaccatatctctggacacgtccagcaatctagttttacccctgaagactgagttctagtgaccgccgctgacacgggtcgtttattactgtgcgagagacggctattatagtatttttgggtagttaggttatttcgacaccctagacgtcggacgggggtccgtaccgaccccgtggggacccgaaggggtaacttaccgttacgggttacccaaccggttccttacccgtttacgtccctacccgtacccggaaaccggggtcccctaacggttcccgggttaccccgtttcccccgttccggtacccctacccccgttaccccgtacccccgtaaacggtaccggtacccc

SEQ ID NO: 142605 - DNA, 593 bp, Homo sapiens
  misc_feature: GYAE6OF02I4IIV.46.67.G01.1.454.CMB.1.raw
  modified_base (263)..(263): a, c, t, g, unknown or other
  misc_feature (263)..(263): n is a, c, g, or t
  modified_base (331)..(331): a, c, t, g, unknown or other
  misc_feature (331)..(331): n is a, c, g, or t
  modified_base (383)..(383): a, c, t, g, unknown or other
  misc_feature (383)..(383): n is a, c, g, or t
  modified_base (472)..(472): a, c, t, g, unknown or other
  misc_feature (472)..(472): n is a, c, g, or t
  modified_base (543)..(543): a, c, t, g, unknown or other
  misc_feature (543)..(543): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaacgtggagacagtgtcaccatcacgttcgccgggacaaggtcggaactattcgactaccttatttaaagttggtatcaaanataacgaccgaaggggaccgacccctaagtcctacctaatcttaatcgtctgcctactccgtagtttnaccggtaaaggtccgggtacccagtcgtagttcgagtggctaggtcgatcgngggaactgtattacactctacactatactagtaactctcaacgtagtagtaatatttacgacttaattacttacttatacaaacgtaanaattaactaagttcgttaccggaccgtaaggtacaactaactaaacgtaaattaaaccaatcgtagtactnactacttacgtgttactctttacgccttaccttcccgcttactctagtac

SEQ ID NO: 142606 - DNA, 816 bp, Homo sapiens
  misc_feature: GYAE6OF02I0FJD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccagtctccatcctcctgtctgacaaccggtggagacaggtcgtccaccatcctacgttcggcccggggacaaggttaccgggaaactagtttacggaacctaacccgtttaaattttaaaaagtttcggggtaaacttaccgaaaactaacgttaacggaaccccgtaacggggggaacccggtaaccccccgtaaaggtccttaaccccgtttaaagttcccgttaacgttaccggccgtttacggaccttaacgttaccccgttaaggttttaccggaacgtaaaaaccggggtttccgggggtaaccctaacgttacggtaacggtttacgacggggttacggaccgtagggttagggtaaccgttcggtaacggggaaaccgtagttaacgttttaccaaccgttacctaccgtaacctagtacctaaagttaccgtcttaacggacctaaacggtagttaaacgttacttttacgaaactttaaccgtttacttaaccggttacgtactaaaacgtaacttaaacgtttaactaagttttcggttaccgaacgaacggtacaacgtaacttaaataaacgtaacgtatggtactctaccgtactcagttcctcgttaccttactccttccgtacccacttactcgtacgtaacg

SEQ ID NO: 142607 - DNA, 619 bp, Homo sapiens
  misc_feature: GYAE6OF02IJOF7.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctcgaggtgccagatgtgacatcgagctgacccagtctccatcctcctgtctgcaaccggtggacacagtgtacaccatcacgttcggccgggcaacgtacggaactagttcgactacttaatttaaatggtatacaactatagaccgagggaccgaccctaagcctactaatctatcgctgctactctagttagacgtaaggtcgggtcccagtcgaggttcgagtggactaggtaggactacggtaggacgtacgtattacactctacactatactaagttactcgtacgacgtaacgttagtaacgtttagttacgaccttaacgtttacttacgttagttaacaacgtaataacttacgtaatttcgggtttaacgacgtaaacggactaacgtaacgtaaacgttaaacgtaaacgtaacgtcgtacggtactacggtacaactacttctacgttctactacgttacctacccgctacgtctagtacc

SEQ ID NO: 142608 - DNA, 630 bp, Homo sapiens
  misc_feature: GYAE6OF02GS2WH.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctaggaatacagttggaagtgtctctcataggtggaggttcctattacagtccgtctctcaagagtcgagtcaccatatctctggacacgtccagcaatctacgttttcccagaacgtatgtattctgtcgaccgccgctcgacgacgggtcttttatcgtgtcgacgagacgacggtcttattagtgttagttttgggagttggtttaagtttcgaccacccgttaagtacgcggtacgggggcctcccgggaccccgtggggacccgaaggggtaactacgtcgggtacctaccgttcgttacccttacgcccgttacccacggaaccgggcccttacggtcccggttccctttccccgtacggtcccacccccgttccctaccaacggcgtacccg

SEQ ID NO: 142609 - DNA, 692 bp, Homo sapiens
  misc_feature: GYAE6OF02H2QLA.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaacgtggagacagtgtcaccatcacttcggcccggganaaggtcggaaactagttcgacctaaccttaattttaaaacttggttaatacctaaactataagacccggaagggaccggaccccctaaagccttacctaaagttctaatcgcttagctaactcctagtttacgactaaagggttcgggtacccagtcggtaaggttcgaggttcggtcaggttcggatcggtggggtaactaggtactttcacgttctaccaacgtactcgtaacgttaacttctagtaccgtaaacggtgtaaacggttatttacgaattaacctttattaacttcgtaaccaaacgtaattaaacttaacaaagttttcggtttaaccgaccggtaaagggtacctaacggtaaaccttaaacgtaaaacgtttaaacggaaacttggttacgactacgctaacgcttagtacgtcttaaccgtacttcccgttacccgaccttagtacccgttgtaaccg

SEQ ID NO: 142610 - DNA, 860 bp, Homo sapiens
  misc_feature: GYAE6OF02IIUBE.46.67.G01.1.454.CMB.1.raw
tcagactagcagtacacgaccggtgctcgatttagagtatacatattggggtttggggagtctcggtcaggacacagcatggacatgacgggtccccgctcagctcctggggctcctgctactctggctccggaggtgccagatgtgacatcgagctcgaccccagtcctccacttcctcccgtgtctgccaaccggtgggaacgacaggtctccaccactcacgttggtccgggactaaacgggtccggaaactactttacggtaaccctaacccgtttaaattttaaacgtttacggggtaacttaccaaaaccgtaagttaaccggaacccggtaaccgggggtaaccccggggtaccccccttaaaggtccttaacccccttaattccgttaacgtaccgcgtccggtactacggttacccgttaggttttcgaaccggtaaacggggttccggggtacccgtaagttaccggtacggttacgtaaggtcgggactagggttcgggtacttacggtacgggtactagttactttcacgtctaacctacgtacttacgagttaactaggtaccgacggtaacgtagttaagttcgtttaacgaccgtttaaagtttactttaactaccggttaaactaaaccgtaagtttaaacttaaaccgttagtttttacccggtttaccgggtaaaccggtacgggtaaaccttaaccgtaaacttaaaacttaaacgttaaaacccggttaaagtcgggttacggtaccgttacggtaacccgtaccttaacgttaccggtttacgtttaccttaaccgttccgttaccctacccgttctaacgttttccaagtttaacccg

SEQ ID NO: 142611 - DNA, 950 bp, Homo sapiens
  misc_feature: GYAE6OF02IZO3G.46.67.G01.1.454.CMB.1.raw
  modified_base (283)..(283): a, c, t, g, unknown or other
  misc_feature (283)..(283): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggtagtccgggcccacgacgtgggtcgaggcccttcgggacgtacccctgtcccctcacctggccggctgtcctcgtggtcgcctccatcgaggttagttcggttttctccgtgggggtccttcgggggttcccggnacgtcctacccggaggggggaacggggtctaggaacttacgtagtttagggaacgttggttccctcgtacgtaagttacggggtttacgggtacggttttacccgttaagtttaacccggtacggtttcccgttaccttaccgtttaacggaaaagggttacggttacccggtaaggtaccccgtaaccctaaagttttacccgttccgtttacgggtaccgggtaaaccgtacccggttaccgaaaggtaccttaaacttccggttttaacccgtttttaccccgaagggtaagtaactttcgggttaagtttcccgtttacgggttaccggtaccccgggtacccgtacgtaaccgggtaaccggttaaccggggtttaccgttttaacgtttacggttacgggttcgtaccgggtaacggtaacgggtacggttaccgttaagtttagttaacggtttttaggtttagggtttacgggttttacgggtaaacgtttttccggtaacttacccccggttaaggtacgggttcgggtacccgggggtacccgtaccgggtacccccggttacgggggtacccgtaacgggggtaacgtttaaccggttacgggtttaccgtacccggtttaccccttcccggtttaccggtccccgttaaccccgg

SEQ ID NO: 142612 - DNA, 1123 bp, Homo sapiens
  misc_feature: GYAE6OF02JTIEX.46.67.G01.1.454.CMB.1.raw
  modified_base (164)..(164): a, c, t, g, unknown or other
  misc_feature (164)..(164): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactcggtgaggcccttcgggagacccctgtccctcacctgcncctgtcctcgtggtcgccctccagtccaggtagtggtttccttcgtcggggcttcggggtcccggacgtacgtcctaccccggaagggggtaagggtccgtagggtaaactaccgaggttacgggaacgttcgtccgtccgtacgtaagttaaggttcgggtaacggtttcccttaagttaaccgacggtttaccggtccttccgttaccgaaaggtacggttaccggaacgttacctaacccgtaacttacttccgttacgttgggaaccctaccgtaccaaggcctaagttaccgttacgttttcccccgaagaagggtacttacggtacgttttaccggttagtaccggacccgggtccccgtacggtttacggaaccccgtacggggggtttaacctttttaacgtttaccgggtacggtttaccggggaaccgggtaacggtttaaccgggggtaaacccggtttacggtttaaacccgtttaagggtttacccggttttaaagggttttttaccggggttaaacgggttttcgggtttttaaaacgttttcccccgggaaaaccgttttacccccggggttaaacgggttaaaccgggttcccggggggtttaaccccgggggggtacccgttttaaacccccgggggggtacccccgggtttaacccgggggggtaaccgggttaaaacccgggggtaaccggtttttaaacccgggttaaccggggttaccccggttaaaccccggtttacccggtttacccgtttaaacccccggtcccgtttaaacccccgggtaaccccggggtaaaccggggttacccccggttaccgggtttacccccgggtttacccccggtttacccccccgggttaccgggtaaacccccttcccccccggtttaacccctttaaccccgggtaacccggggtacccccggttaacccccggg

SEQ ID NO: 142613 - DNA, 502 bp, Homo sapiens
  misc_feature: GYAE6OF02I30IS.46.67.G01.1.454.CMB.1.raw
  modified_base (159)..(159): a, c, t, g, unknown or other
  misc_feature (159)..(159): n is a, c, g, or t
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgaggtcccgctcagctcctggggctcctgctactctggctccgagtgccagatgtgacagtccgagctgacccngtctccatccncctgtcagcaacgtgganacagtgtcacatcactgccggntaagtcggaacattcgactactatttaaagtggatcaaagntagacctagggacnccctaagctcaagtctaatnactnacnctcagtttgacaagtcggtaccatcgagtcagtgacatgaatcaggananacttnacttncacagtnagtanctgacagtnagtntttagnaacttataacttgacaacagtaatacaaattcgtttacgcctaaggacacgaacctanaaattaacaagttanggtacngacncaagtctntacttnagtcttcnctaattccnggtaa

SEQ ID NO: 142614 - DNA, 729 bp, Homo sapiens
  misc_feature: GYAE6OF02GL7UQ.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgacgtggtgacggccttcggacgaccctgtccctcacctgcgctgtctcgtggtcgcctcatcagtagtggtttcttcgtggggctgggtccgcacgccgtccgaggggagggctaggaatacgagttaggaagttgtctcgtacaagttaggtggtacggtttcctaagttaccgtacggttcccgtcttccgtacgtaaggtaggtccgtagttacccaacctagttacttcctacgtacggacctaaccggtcctaacggacttaaacgtcgttaacgttttacccgaggaacgtagttacgtagtttcgtgtcggaccccgtcgtctacggacggtacgggttacttttacgtacgtggtcgacggtagagtacgtacttaagtttgtaggtttagttttaggtaggttttgtttaacgtttaccgaacctaccggttaagtacgtccggggtaccggggtccttaccccgggtacccgggtacgggacccgggtaaggtaacccgttacggttacggtacccgtaccggttacccgttccggttacccgccccgtaacccccgg

SEQ ID NO: 142615 - DNA, 1013 bp, Homo sapiens
  misc_feature: GYAE6OF02HRH6B.46.67.G01.1.454.CMB.1.raw
  modified_base (109)..(109): a, c, t, g, unknown or other
  misc_feature (109)..(109): n is a, c, g, or t
  modified_base (283)..(283): a, c, t, g, unknown or other
  misc_feature (283)..(283): n is a, c, g, or t
tcagactagcagtacacgaccggtgctcgatttagagtatacatattgggtttgtcctcctgctggtggcagctcccagatgggtcctgtccctggtgcaactgcaggngtccgggccacgactggtgaggcctttacgggagaccctgtccctcaccgtgcgctgtctcgtggtcgcctcatcagtagtcggtttctcgtgggctcgggtccggacagtctccgagggaacgggctaggaactacgattaggatgtctctacagtgtggtagttctattacngtacgtccttactacaacggtagtacgagtacctaacccattaactccgttacgtacgggtacctacggtacccgactaccgtaaacgttcgttaaccggtttttaccccgtaagggtaaacggttacgttaaccgggtttaattttacccggtttagggtttaccccggtaccccggtacccccgggtacggtttaaccgggtaaccccgggtttaaaccggggggtttaacccggttttttttaacgtttaaaccggttcgggttttaaccgggtacccgggtaaagggtaacgggttaaacccgggggtttaacgttttaaacgtttaacggtttttaagggttttacggttttttttaacgggggtttagggttttttaacggggtttttaaaccggtttttaaccggttaaaccccggttaaacccgtttaacgggttaaacgggtttacccgggggtaacccgggggtttaccccggttaacccggggttaacccccggggttacccggggtaaaccgggtaaaaccggggttaaccgttttaaccggggtaccgttacccgggttaacccggttaaccccgttttacccggttacccgttaccccgttacccgtaaaccccggaacccggggttacccgtaccggttaccccggtttccccgtttaccccccgtcggtaccccttaccccgttaccccgtaacgtaccgggtacctaccccgg

SEQ ID NO: 142616 - DNA, 714 bp, Homo sapiens
  misc_feature: GYAE6OF02IZYBH.46.67.G01.1.454.CMB.1.raw
  modified_base (562)..(562): a, c, t, g, unknown or other
  misc_feature (562)..(562): n is a, c, g, or t
  modified_base (695)..(695): a, c, t, g, unknown or other
  misc_feature (695)..(695): n is a, c, g, or t
  modified_base (706)..(706): a, c, t, g, unknown or other
  misc_feature (706)..(706): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgcagatgtgacatcgagctacgaccctagtcctaccactcctcccgtgtccgtcgaccgtaaccgggtgggacgtacgtacggttcgtaccacctactaccgtacggttccgggaccgggtaacgtaacgggtaccggtaacttacgttacggtaaccttaaacgtttaagtttaaagttacggtaactacctaaacgtacggtaacccggaaccgggtaacgggtacccgtaccctaagtccttaacgtactacgtgtacgcgtctactacgttcgagttacggacgttacgggtctcagttcgtcttgtacgcggtagtacgtggtacgtcgtacgggtacgtacttcttacctacgtacctacgtactaaactcgttatacgtaactcggtatacgtagttacgttacttactaactactttacngttaactaacgtacgtaacttaagttacttacgtcgttacgaccgaagtacgaactaacgaacttaaacgtactaagtcgtacgtactacctacgtctactttacgtcttactacgttccctacggttacccncgtacgttacngttaaccg

SEQ ID NO: 142617 - DNA, 708 bp, Homo sapiens
  misc_feature: GYAE6OF02HVA9H.46.67.G01.1.454.CMB.1.raw
  modified_base (673)..(673): a, c, t, g, unknown or other
  misc_feature (673)..(673): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagtctcgaccctagtcctccattccctccctgtcgtgaccgaaccggtgggacgtacgagtcgtacaccgtattcacgttcgggcccggtacaacggtcggaaactgtttacggaacctaacctttaagttttaaaacgttgggttaactaaccgaactaagtaccggaaccggaacggggaccgtaacccctaaggtccttaccttaattctaagtcgcgtagacctaatccgtaggttacgaacggtaaggtcgggtaccagtccggtacggttcgaaggtggacgtaggtgtacgttacgtagggactaggttacttacaccttcctacactacgtacgtacgtactcgtacgtaaccgtaaggtacgtaagttactttacgtaccttacgttacttactacgtaactaacgtaataacttagtaacgttcggtttaccgaacgaagtaccaacgtaactaaactaaacgtaacgtaacggtagtacggtactaccggtaccacttaactctacgttacncttacgtccctaccgttactacttcgtattaacgg

SEQ ID NO: 142618 - DNA, 635 bp, Homo sapiens
  misc_feature: GYAE6OF02IYJ7L.46.67.G01.1.454.CMB.1.raw
  modified_base (386)..(386): a, c, t, g, unknown or other
  misc_feature (386)..(386): n is a, c, g, or t
  modified_base (420)..(420): a, c, t, g, unknown or other
  misc_feature (420)..(420): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccagtcctccctgtcctggacctaaccggtgggagactagtcgtaccacccatcaacttggcccgggacaaagtcgggaaacattcggaacctacccttattttaaagtggtactacaacatacgaccgaacgggacggtcccctaagctaccgtaatctatgactgacatcctagttcgacaagtcgggtacccagtcgtagttcagtgcaggtcgatcgngggacagtattcactcacctacactactagtaancgtcgactaacggtagaacgttagtttacgactaaacgttatactacgtacaactagttaataacgtaagtcgtttaacggaccctaaggggtaccaacgtaacgtaaactaaacgttaaacgtaacgtacgttacgagtacggtaacctaaccgtacttacgtacgttaccgttacctagttaccctacccggtacctaacgttcctacggtac

SEQ ID NO: 142619 - DNA, 816 bp, Homo sapiens
  misc_feature: GYAE6OF02HSGJF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacgagtcgtccaccactcacgttcggcccgggacaacggtcggaactagttagaacctaccttaatttaaagttggttactacaactaataacggaaccgaaggggaaccggacccctaacggtcctacctaactacttatcgcttcgacctactccgtaggtttacgacgtaaagggttccggggtaccctaagttccggtaaggttcgaaggttcggacgtaggtacgggacttcgtacggggtaacgtaacgtacgtttaccgtaccttacccttacgaacccttacgttaacgtaagttaacgtttcgtaacggtaacccgtaacggttaggttaaaacgttctttttaacgaaccgttttaaacttttacggtttaaccgtttaacgttaaccgtaaaacgttaaaccgttaaactttaaacgtttaacgttttaccggttttaaccgggtaaccggtaaacgggtaacccgtaaacccgtaacttaaaaaccgtaaaacgttaaaaccggtaacgttagttaacgggtacctacgtaaccgtaaccgtacttacgttccggtttacctttaaccgtaccttcccgttacccgtccctaacttccgttagttaacccg

SEQ ID NO: 142620 - DNA, 711 bp, Homo sapiens
  misc_feature: GYAE6OF02HBI75.46.67.G01.1.454.CMB.1.raw
  modified_base (215)..(215): a, c, t, g, unknown or other
  misc_feature (215)..(215): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccagactggtgaggccttcggagaccctgtcccctcacctgccgctgtctcgtggtcncctccatcagtagttgttctcgtgggctcggggtccgcagccgtcccgaggggacgggctaggaactacagttggaagtcgtctcgtctagtaggtggacggttccttaattacgacgttccgtctcgtacgaacggtacgtcgacgtaccaaccattactcgttcgtggactaccgtaccgagtactaattccttaacgtttttcccaaggtaactacgttagttacgtttcgtacggttccggaacccgtcccggtctacggtaaacggtccggggtttaacttttaacgtacttcgggttgaccggtaggacgtacgtacttagtttagtacgtttaggttttagggagttttacggttactttaccgaccgtaaccgttaggtacgtaccggggtacggggtcccgttaccggtcccggacgggaaccggtaacgggtaactacggttccggtaccgtaccggttcgttaccctttacggcccttaacccgg

SEQ ID NO: 142621 - DNA, 668 bp, Homo sapiens
  misc_feature: GYAE6OF02GN459.46.67.G01.1.454.CMB.1.raw
  modified_base (352)..(352): a, c, t, g, unknown or other
  misc_feature (352)..(352): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccgcagctccgagggaggggctaggaatacgagttggaagtgtctctctagtaggtggtacggttcctattacagttccgtctctacaagagtcgagtcacctatatctctcggacacgtcagctaatctacgtttccagaagtntagtagttctgtcgaccgcgtcgtacgacgtacggttacttttatacgtgtcgacgaggacgacggtacttagttagtgttagttttagggtagtttaggtttacgttaccgaccgtaccgtagtacggttccggaccggggtcctaccggtacccggtacggggaccgtaacgggtaacgttaccgtacgggtacctacccggttccttacccgttaccgtcccgtacccgaacccggtaaccggtaccctaccggttccccggttcccttcccccggtcggtaccctccccgtcccgaccgtacgccgtacccg

SEQ ID NO: 142622 - DNA, 614 bp, Homo sapiens
  misc_feature: GYAE6OF02JI5UD.46.67.G01.1.454.CMB.1.raw
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacngtgtcaccatcacttgccggcaagtcggacattgacacctatttaaatggtatcaacatagaccagggacgcccctaagctcctaatctaatgctgcatccagtttgcaagtgggtcccatcgagttcagtgcaggtgatctgggacagtatttcacgtctacacctatctagtaatcctgaccaggttagaagtattttcggactaaactttagttaccttaggtacctaaactaggtaaacctttaagtaaagtttcggttttaccggacccgtaaacggggtacctaagggtaaaccttaactaaaagttaaaccgtaaacttcgggttagccgttaggacccgttaaccgtattaccgtacggttaccgtttacacgtttaccttaccccgtccgtactttccgttaagtaaccg

SEQ ID NO: 142623 - DNA, 701 bp, Homo sapiens
  misc_feature: GYAE6OF02F8338.46.67.G01.1.454.CMB.1.raw
  modified_base (170)..(170): a, c, t, g, unknown or other
  misc_feature (170)..(170): n is a, c, g, or t
  modified_base (285)..(285): a, c, t, g, unknown or other
  misc_feature (285)..(285): n is a, c, g, or t
  modified_base (466)..(466): a, c, t, g, unknown or other
  misc_feature (466)..(466): n is a, c, g, or t
tcagactagcagtacacgaccggtgctcgatttagagtatacatattgggtttgtctcctgctggtggcagctcccagatgggtcctgtcctggtgcaactgcaggagtcggccacgactggtgaggccttcggacgaccctgtccctcaccgtgcgctgtctcgtggtncctcatcagtgtcgtttctcgtgggtcgtgggtccgcagcctcccgagggaagggctggtaactacgattcgggagtcgtacctcgtactaagtggtgtacggttcctagttacncggtaccttctctcgaagtacggtcgaggtctactatactcgtcgtacggacctacgtaccacgtactaactctacggttttcccagaatacgtatacgttcgtgtccgaccggtccgcttcggaacggtcggggttctttaagttaccgttgtacgacgtacggagtacggtactacgtntagttagttttacgtaggttaggttacttacggttacctaccgtacgtacgtacgggtacgggtacgtacccgtacccggtacggaccggtaacggtaccttacggtacggtccgtaccgttaccgtacccgttacgtaccgtaccgtaacccgggccggttacccgaaccggtcccgttcccgttcccccgtcgtaccccgtaccccgttacgtacccgacgtacccgtacccg

SEQ ID NO: 142624 - DNA, 623 bp, Homo sapiens
  misc_feature: GYAE6OF02IENE6.46.67.G01.1.454.CMB.1.raw
  modified_base (248)..(248): a, c, t, g, unknown or other
  misc_feature (248)..(248): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttctcgtgggctgggtccgcagctccgagggagggctaggaatacgagttggaagtgtctncagtagtggaggttctagttacagtccgtctctcaagagtcgagtcaccagtactctcgtggacctacgtccagcaatctacgttttccagaagatgagttcngtcaccgcgactcgacgtacggtctttactacgtgtcgcgaagcgacggcttattatgttatttggagttgttattacgacctaccgtagtacgtcggtacgggtctaccggacccggttgggaccgtaagggtaacgttacggtcgtaccgtaccggtccttaccgttacgtccctaccgtacccggtaacggtcccctacggttcccgttacccgttcccccggttcggacccctaccccgttacccgtaacgtacccgacgtaccccgg

SEQ ID NO: 142625 - DNA, 883 bp, Homo sapiens
  misc_feature: GYAE6OF02FIEI3.46.67.G01.1.454.CMB.1.raw
tcagactagcagtacacgaccggtgctcgatttagagtatacatattgggtttggggagtctcggtcaggacacagcatggacatgagggtcccgctcagctcctggggctcctgctactctggcctccgaggtgccagatgtgacatcgagctgaccccagtcctccatcctccctgtctcgcaacccggtgggacgacaggtcgtcacccatccacgttggcccgggcaacggtccggaaccagtttacgacctacccttaagttttaaaacgttgggttaactaccaaaccgtacttaacggacccgtaacgggggacccgggtacccccctaaaggcccttacccgtaaccttccttaactcggcctaggtacctacgttacccgtagttttacgaccggtaaaacgggttccgggggttaacccctaaggttcccgggttaaacggggtttcctaaggggttacggtacccggtaagggttacggggtaacttccgggttaagggggtaaacccctaacgggttaccttttacccaaccgtttttacccgtacccctaaacccggttaactacctaacggtttaaacccgtcgtaccggtaacccgtaaacggttaacggtaaacggttactttttacggaacccttaaactttaacgtttaaccgttacgtaacctaaaccgttaacgtaaaccgtttacttaaagtttaccgggtttttacggaacccggtaaacgggtaaactaacccggtaaacttaaaccgaaaacctttaaaccggaactttacgggtagtaccgtaacgtacctaaccctacgttaccgttaacctcgtttaacctacgttcccttacccgtcctacgttctacgtaaccg

SEQ ID NO: 142626 - DNA, 589 bp, Homo sapiens
  misc_feature: GYAE6OF02I1OSR.46.67.G01.1.454.CMB.1.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (585)..(585): a, c, t, g, unknown or other
  misc_feature (585)..(585): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaacggtgganactagtgtcaccatcacttggccgganaaggtcggaactattcgacacttaattaatggtancaacatacgacgaggaccgccctaaanctactaatctatgcctagcaatcctaggtttgacgtaaagggtcggtaccctaagtcggtaggttcaggtcggcaggtgactcgtagggacagtacgttcactcacactatactaacgtatctagacgtaaacgttgaaagttactttagacttaaacttagttacgttacgtaacaaataagtaaactttactaagttttcggttaaccggtaacgaacgggaactacgtaaactaacttaaaataacgaatgtagactacgacaactatcgtcttccgttataacttccttacctctagttcctntaac

SEQ ID NO: 142627 - DNA, 642 bp, Homo sapiens
  misc_feature: GYAE6OF02FXQ8C.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgccaaccggtgggagacagtgtccacctatcacgttggccgggacaaggtcggaactattcgactaaccttaatttaaagttggtatacaaacataacgaccgaagggaccggacccctaaagccttacctaatctatgctgcatcctagttcgacgtaaggtcgggtacccagtcgaggttcaggtcggacgaggtgactcgtgggacagtattcacttctacactatcgaagttactactgtacgaagtagtaagttacttttacgacctttaaacgtttacttacgtaactaactaaactagtaaactttaattagtttaccggttacgtaccggaacgggtactacgtaaacttaacgtaaaataacggtaactaggtacggtcgtcgtacgtacctattaccgttagttaccttaccttacttccccgttaaccgtccgtaaccttccgtagtaccg

SEQ ID NO: 142628 - DNA, 659 bp, Homo sapiens
  misc_feature: GYAE6OF02I0BER.46.67.G01.1.454.CMB.1.raw
  modified_base (170)..(170): a, c, t, g, unknown or other
  misc_feature (170)..(170): n is a, c, g, or t
  modified_base (312)..(312): a, c, t, g, unknown or other
  misc_feature (312)..(312): n is a, c, g, or t
  modified_base (468)..(468): a, c, t, g, unknown or other
  misc_feature (468)..(468): n is a, c, g, or t
  modified_base (501)..(501): a, c, t, g, unknown or other
  misc_feature (501)..(501): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagccctgtccctcacctgcgctgtctctggtncctcatcagtagtcggtttcttcgtgggtctgggtccgctacgccgtacccgaggggaaggggtctagggaaacttacgagttgggaagttggtcctcgtactagtaggttggaggtttcctaagtttacaggttacccgtnttctacgaaagagttcgaagtccaacctatactctctggactaacgtcaagcaaatcacgttttcccagaagactagtacgttctgttcggaacccgcgtacgtcgacgacggggtacttttacgtacttgtacgtcgaagtagacgtctattaangttatttgagttgtagttccgtactaccgtagntcgggtacgggtcctcgtacccgcgggtacgaggtaacgtacgtaggttccagtccgttaccgtccgttacgtcctacccggtaacggaaccggtccgaaccgttaccggttcccgttcccccgaggtacccctcccctaccgtaccgaacgtacccg

SEQ ID NO: 142629 - DNA, 723 bp, Homo sapiens
  misc_feature: GYAE6OF02HBOEV.46.67.G01.1.454.CMB.1.raw
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (355)..(355): a, c, t, g, unknown or other
  misc_feature (355)..(355): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtcccctcacctggccgcttgtctctggtcgccctccatcaggttacgttggtttcttcgnggggtctgggtccgnacgcctccgaggggacggggctggaatactagtggaagttgtctctactagtaggtggtacggttccttattaccgagtccgtctcacgaagngtcgacgtacaccgtatactctcgtacggactccgtaccagtactagtaccttacgtttcccgtagaacggtattggttacgtttcgtcggtacgaccccgggtccgtcgttaccggtaaccgggtccgggttacgttttaacgttcgtagggttcgacggtaacggacggtacggtactttaggttacgtttgggttttaacgttttagggaagttttacgggtttaacgtttaccgaccgttaaccgttacgtacggtccgggtacccggggtctaccccgggtacccggggtagggaccggtaaggtaccgttacgtacggtacccgtccggttacccgtttcggtacccgtcccgtaaccccgg

SEQ ID NO: 142630 - DNA, 666 bp, Homo sapiens
  misc_feature: GYAE6OF02HDTSP.46.67.G01.1.454.CMB.1.raw
  modified_base (213)..(213): a, c, t, g, unknown or other
  misc_feature (213)..(213): n is a, c, g, or t
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgccgctgtctctggtcncctcatcagtagtggtttctgtgggctgggtccgcagcctccgaggggagggctaggaatacgattggaagtgtctctcatgtggacgttcctatacngtccgtctctacaaggtacgtcgacgtcacctatacgtctcgtacggactaccgtcaanacgtaaacttccgttaacgttttcccaagtaacgtatacggtacgtttcgtacggtaccgaccccggtccgtcgtaggaacccggtacgggttcgttttaacgttcgttggtcggacggtacggaccggtacggactttaagttagttgtttaaggttttggacgttttggtttacttaccgacctaccgttagtacgtccggggtacgggctacccgggtaccggttccggggaaccgtagggtaacttacggtcggtaccgtcccgttcccgtaccgttacgtcccctaaccgg

SEQ ID NO: 142631 - DNA, 709 bp, Homo sapiens
  misc_feature: GYAE6OF02JO15D.46.67.G01.1.454.CMB.1.raw
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatcacttgccggnagcganttgactacctattaattggtatacaacatacgaccagggaccgacccctaagtcctactaatctaatgctgactactctagtttagacgaagttcggtaccagtcggtagttcgagtggacgacgtggtatcgtaggtactaaggttactttacgactttcctacctaaccgtactcgtaagtaactcgtagtaacgtaacggtagtaacgttagttttacgacttaaccttaactttaaccgttagtaacctaaacgttaacgttaacgtttaaacgttacgtttaacggtttttaaccggacccggtaaacggggtaaccttaaaccggtaaccttaaacgttaaaaaccgtttaaacggttaacccgttaaggtaccggtacgttaagtacccgtaaaccctaacgttacgttaagttcccttttacggttaaccctttccccggttaccccgttaacccttacgtttaccgtaacgtttaacg

SEQ ID NO: 142632 - DNA, 628 bp, Homo sapiens
  misc_feature: GYAE6OF02GAMPP.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagttagtggtttctcgtgggctgggtccgcagcctccgagggagggctggaatacagttggaagtgtctctctatagtggaggttctattacgacgtccgtctctcagagtcgagtcacatatctctcgacacgtcagcaactctacgtttcccgagacgtatgtagttctgtcgaccgcgtcgtcgaacgtacgggtactttataccgtgtcggacgtagacgacgtcttattattacgttagttttaggagtttaggtttactttccgtaacctaccgttaagtacggtaccgggtaccggggtcctacccgggtacccggtccggggacccggtaacggggtaacgttaccggttccggtaccgtaccccggttcctttacccggtaccggtccccgtaaccccgg

SEQ ID NO: 142633 - DNA, 632 bp, Homo sapiens
  misc_feature: GYAE6OF02JSW90.46.67.G01.1.454.CMB.1.raw
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacngtgtcaccatcacttgccgggcaagtcggaacnttcgacaccttatttaaatggtatcaanatacgacgacgggaccgcccctaagctacctaactctatgctgacactcctagtttacncgtaaacgtcggggtacccagtacgtacggttcaggtggacgtaggtaggtatcgtacgggactacggagtttcaactccgtcaccagtcagtaactcgtcgacctaggtagaagttactttagactaactttagtttaactacgttactaaacgagtaaactttacgtaacgttttacgtttaccggtaccgtaacggtaaccgtacgaacgttaaataaacgttaaaccgaacgttagtacggtactacgtaccgaactacgttactacgttacttaccgtacttacccttcccgtacctacttacgtacgtacg

SEQ ID NO: 142634 - DNA, 709 bp, Homo sapiens
  misc_feature: GYAE6OF02ILINK.46.67.G01.1.454.CMB.1.raw
  modified_base (309)..(309): a, c, t, g, unknown or other
  misc_feature (309)..(309): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtgggctgggtccgcagctccgagggagggctaggatacagttggaagtgtctctcatagtggtaggttcctattacagtccgtctctcaagagtacgagtcacctatatctcnggacacgtcagacaatctacgtttccagtaacatgtagttctgtacgaccgccgtcgtacgacgtacgggtacttttaattaccgtggtcgacgaaggtacggacggtacttaagttaacgttaggttaagtttttagggtaaggttaggtttacgtttaccgtaaccttaacccgtaagttacggtaccgggtaccgggggtacctacccggtaaccccggtacggggaccgtaacgggtaacgttacgttacggtacccgtaccgttaccttaccgttacgtcccgtaaccgtaacccggtaaccgggtacccctacggttcccggttaccccgtttaccccggtaccggtaccccgttacccctaccccggtaacccgaacggtaccgtaaccccgg

SEQ ID NO: 142635 - DNA, 633 bp, Homo sapiens
  misc_feature: GYAE6OF02IF532.46.67.G01.1.454.CMB.1.raw
  modified_base (208)..(208): a, c, t, g, unknown or other
  misc_feature (208)..(208): n is a, c, g, or t
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
  modified_base (400)..(400): a, c, t, g, unknown or other
  misc_feature (400)..(400): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctccgagggagggctggatacattggaatgtctctcatagtggaggttcctattacagtccgtctctcaagngtcgagttcaccattactctcgtggactacgtcagcaatctacgttttccngaacgatcgtagttctgtacgaccgcgtcgtggaccgtacggtcttttaattacgtgtcgcgaaggngtacggtctaattacgtggttattttgggagtttggtttagttaccgtacctacccgttaggacgttaccgggaacgggggtcctaccggccccggttagggggaccctaaggggtaactacgttcggtaccctaccggtcttccgttaacgtcccgtaacccgaccgtaacggcccgtacgtcccggttcccgttacccgtcgccctaccctccctacgacgtacggtaccc

SEQ ID NO: 142636 - DNA, 806 bp, Homo sapiens
  misc_feature: GYAE6OF02GY0I1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccagtcctccctgtcctgccaaccgtgggagacaggtcgtcaccatccaactttcggcccgggactaaacggtaccgggaaactatttacggaacctaaccttaattttaaaagttgggttaattaccctaaagacttaacggaacccgaacggggtaaccggtaccccccctaaaaggtcccttaacccgttaaacgttccttaacgttcggacttacggacctaacttacccgtaaggtttttacgaacgtaaaaacgggttcgggggttacccctaagttaccggtaaggttaccgtaaggtcggaccgttagggtacggtaacgtccgttaggggaaccttaggtaacttttaccgaaccggttccgtaacctaacctacgttaacgtaacggttaacttacgtacgtaccgtaaacggtacggtaaagttcgtttaaggtaccttaaacgttactttacgtagtaacctaaacgtaagtaaacttaacctaagttccggttttccgaaccgtaacgggtaacctaacgtaaccgtaaactaaacgttaaacgtaactggttacgtacttacggtacaccgttaactccgttactacccgttattccgtaacttcccggtactcgttactagttaacc

SEQ ID NO: 142637 - DNA, 613 bp, Homo sapiens
  misc_feature: GYAE6OF02IXD48.46.67.G01.1.454.CMB.1.raw
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtcccggcagctcccgaggggaagggctggaatacattggaagtgtctctcagtagtggaggttcctattacagtccgtctctcaagagtcgagtcaccatatctctggacacgtccagcaatctagttttcccngaagntgagttctgtcgaccgcgctgacgacgggtctttatactgtgcgagagacgctattagtgttagttttggagtttggttatttacgactacctagtacgtcgggaccggggtctccgtaccccggtggggaccgagggaacttcgtcggttacctaccgttccttaccgttaccgtccctaccgaaccgaaccgggccctacggttccggtcccctttcccccgtcggtacccctaccccgttccgtaccccgtaacgcgtaaccccg

SEQ ID NO: 142638 - DNA, 654 bp, Homo sapiens
  misc_feature: GYAE6OF02IAZIX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctcatcagtagtggtttctcgtggggctgggtccgcagcctccgaggggacgggctggaatacagttaggaagtgtctctcattagtggtacggttcctattacacgtcctctctcgaagagtcgagtcaccattactctcgtaggacaccgtcagctaatctacgttttcccagtaagtatagtacgtttctgcgacccggtccgtctacggaccgtacgggttcttttaattaccgtggtacggacggtaaggacgtaccgggtacttaagtttagtagtttagtttttaggggtagtttaggttttacttaccgaaccttaccgttaagtaccggtcgggacgggtcctcccggaccggtcggggacagggtacttcgtcgtacctacgtccttacgtactccgtaccgaccggacggtccctacggttcccgttacccgtcccgtcgtaccccacccttccaccgtaccgctacccg

SEQ ID NO: 142639 - DNA, 616 bp, Homo sapiens
  misc_feature: GYAE6OF02ILV8E.46.67.G01.1.454.CMB.1.raw
  modified_base (85)..(85): a, c, t, g, unknown or other
  misc_feature (85)..(85): n is a, c, g, or t
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (290)..(290): a, c, t, g, unknown or other
  misc_feature (290)..(290): n is a, c, g, or t
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
tcagactagcagtacacgaccggtgctcgatttagagtatacatattggggtttgggggagtctcggtcaggacacagaatgganatgagggtccccgctcagctcctggggctcctgctactctggctaccgaggtgccagatgtgacatcgagctgacccagtctccatcctccctgtctgcaaccgtggganacagtgtcaccatcacttcgccgggacaagtcggaanattgactacctatttaaatggtatcaacatagaaccagggacgccctaagctactaanctatgctgacataccagtttgactaaaggtcgggtacccagtcgtaggttcagtggcagtaggatcgtaggganagtatttcactactcaaccagtacagtaactcgtnacgaagtgaagttatttagactaactttaattacgtacgttaacaaactaagtaaatttaacctaaagtttcggttttacggaaccgtaaacgggactaaccgaacttaacaaaacgtttaaaacgaacgttaggtacgacgttacgacctaacgtagttactacgtaccttacgtaaccttccgttacccgtacctacttctacggtacttaaccg

SEQ ID NO: 142640 - DNA, 666 bp, Homo sapiens
  misc_feature: GYAE6OF02IQ9X5.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtggganacagtgtcaccatcattggccgggnaagtcggaanttgacactattaaatggtatcaanatagaccgagggaccggtaccctagctacctaatcctatcgctcgacacttcctagtttcgacgtaaaacgggttcggggtaccccaagttcggaaggtttccgaaggtcggactaggttagggattcgtagggactagtatttcaactctcaactatctaagtaatctagtacaacgtagtaagttatttcgaactaactttaattactacgttaacaaacgtaagttaaacgttaactaacgtttcggttttaaccgggaccgttaaaggggaaccctaacgtaaccgttaaactaaaaacgttaaacgaaacgttggtaccgtctaacggacctaaccgtattaccgttgtttaccctttacgtaccgttacccgttaccccgtaccggtttaacttaccgtagttaaccg

SEQ ID NO: 142641 - DNA, 623 bp, Homo sapiens
  misc_feature: GYAE6OF02I3UVU.46.67.G01.1.454.CMB.1.raw
  modified_base (465)..(465): a, c, t, g, unknown or other
  misc_feature (465)..(465): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtcctccatccctccctgtctcgctaaccggtgggacacagtgtcaccatcacgttcggccgggacaacggtcggaactacgttcgaacctacttaattttaaagttcggtaactacaactatacggaaccgagggaccgacccctaagctacctaatctatgctgctactcctaggttacgacgtaacgggtcgggtccagtcggtagttcgaggtcgcgtaggtggtagtcgtacgggactagtactttcgaaccttctacactatactaagtactcgtacgacgtaacgtagtaacgtttntttacgaacttacttattaccttagtactanaacgttaacttaactaagtttcgttacggtacaagggtaccacgtaactaactaaaactaacgattcgtacgacgtcgactacgtatcgttacgtacttcgtactcccttaccgctagtcctagtac

SEQ ID NO: 142642 - DNA, 542 bp, Homo sapiens
  misc_feature: GYAE6OF02FGKWZ.46.67.G01.1.454.CMB.1.raw
  modified_base (191)..(191): a, c, t, g, unknown or other
  misc_feature (191)..(191): n is a, c, g, or t
  modified_base (303)..(303): a, c, t, g, unknown or other
  misc_feature (303)..(303): n is a, c, g, or t
  modified_base (441)..(441): a, c, t, g, unknown or other
  misc_feature (441)..(441): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccgtggancagtgtcaccatcacttgccgggcaaaggtccggacatttgacacccttatttaaattggtaatcaacatacgaccagggacggcccccaagcctacctaatctatcgactncactcctagtttagctaaagtcgggtacccactcgtaggtcaggttcgcgagtggatcgtggacaggtacttcgtactcgtacacctatacctagtaactctagacctaacgtagtaagatttgaccaattattactnttacgactagaacttacatttagtcgtcaaggacacgtaactaacaaattaaacgatcgngtcngcaactgtctgctanactcctacccgnactntgtaac

SEQ ID NO: 142643 - DNA, 746 bp, Homo sapiens
  misc_feature: GYAE6OF02H3DA1.46.67.G01.1.454.CMB.1.raw
  modified_base (142)..(142): a, c, t, g, unknown or other
  misc_feature (142)..(142): n is a, c, g, or t
  modified_base (211)..(211): a, c, t, g, unknown or other
  misc_feature (211)..(211): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggganaccctgtccctcacctgcgctgtctcgtggtgcctccatcagtagtggtttctcgtgggctgggtccgnagctccgagggagggctaggaatacgagtttggaagttgtcctctcagttaggtggacggtttcctaattacaggttccgtctcgtacaaggtgtcgaagtccaacctatagtctcaggaccacgtccagtcaatctacgtttaccngaanattgacgttctggtcgaccgcgtctgaaccgtcgggtcttttaattcgagttcggacggtagacggtacggtactttaagttagtagtttagttttacgggtaggtttcggttttaacgtttaccgtaacccgtaacccgtaaggtacgtaccgggggaaccggggtccttacccgggttaccccggtacgggggtaacccgtaaaggggttaaacgttaacccggttacgggttaacccgtaacccggtttccgttacccgtttaaccggtaccccgttacccggaaccggtaaaccgggtcccctaacggttcccggtttaccccttaccccggtcggaccccttacccccgttacccgtacccgtaacggccgtaacccgg

SEQ ID NO: 142644 - DNA, 883 bp, Homo sapiens
  misc_feature: GYAE6OF02HIJ3W.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggaggtcgggcccacgactggtgaggccttcgggacgaccctgtccctcaccgtgcgctcgtctcgtggtcgtcctaccatctaggttagttcggttttctcggtcggggtcgtacggggtccggcacgccgtaccggaggggtaacgggcgtaggtaactacgtagttagggaagttcgtctcgtacgtaagttaggtacgggttaccggtttaccttaacgtttaaccgtacggttcccgttaccgtttcctaacggtaaacggtacggtaccgtaacgtacccaacctacttacttccgtacgtacggtaaccgtaccgtacgaacgtactaaacttcgtttaaccgttttacccgaagtaacgtacgttacggttacgttacgttcgggtacccgtaacccggtccgtacggtacccggtacgggttaccgggtttacgtttttaacgtaccgttgggttcggaaggtacgggttaacggacgtttaactttagtttacggttagggttttaaggttttacgggtaggttttacgggtttttaccgttaaccgttaacccgtaaaccgttaagggtaccggttaacccgggggaccggggttaccccggtccccgggtaaaccccggggttcggggtaaaccggtaaccggggttaacgttacccgggttccggttaacccggttcccgtttacccgttacccgggttttacccgacccccgttaaccccggg

SEQ ID NO: 142645 - DNA, 591 bp, Homo sapiens
  misc_feature: GYAE6OF02GN5F2.46.67.G01.1.454.CMB.1.raw
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctgtccctcacctgcgctgtctctggtcgcctccatcagtagtggtttctcgtgggctgggtccgcagctccgagggagggctggaatacgattggaagtgtctctcagtagtggaggttcctattacagtccgtctctcaagngtcgagtcaccatatctcgtgactacgtccagcaatctacgttttcccngaacgtatagtacttctagtcgaccgccgtctagacgtacgggtctttagttactgttagcgagacgacgtctattatgttattttggagttggttatttcgtaactcctaagtacgtcggacggggtctaccggtacccggtcggggtacccgtaagggtacgttaccgtagggtcctaccggttccgtacccgttacgcccgttaaccccgg

SEQ ID NO: 142646 - DNA, 657 bp, Homo sapiens
  misc_feature: GYAE6OF02FGE23.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgacaaccgtggganacagtgtcaccgatcacgttcgccgggcaagtcggaactattgacctacctatttaaagttggtatcaacatacgaccaagggaccgcccctaagctacctaatctatcgctgcactcagtttcgactaacggtcgggtcccagtcggtagggttcaggtcggtcaggtgactcgtagggactagtcttcactctacactagactataactctacgacgtaaggtaggtaacgttatttacgtacctaacgtttacttacttcgtaacgaaacgtaagttaacttaacgtaacgttttcggtttaaccggaccgtaacggtaacgtaacggtaaccttaaacgtaaaacgttaaaccgtaacgttacggttacggtaccgttcggaaccttaacccgtcgttaccgttaaccgtccgtttacctacgttaccccttcccggacccttacgtcttacggtaacc

SEQ ID NO: 142647 - DNA, 961 bp, Homo sapiens
  misc_feature: GYAE6OF02FK4WY.46.67.G01.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtcctgcaaccggtggganacagtgtccaccntccacttggccgggtcaaggtccgaactattggacctacccgttaatttaaaacgttgggtaactcgaaacacgttaacggaccccgagggggtacccggccccccgttaaaggcccttacccctaaacttccttaacttcggacctttcggacctaactttcccgtaagtttttacggaccgtaaaaacgggttcggggggttaccccaagttccgggtaacgggggttttaccaacggggttcggggacccttaaggggtttacggggggtaactttacccggtggggggtaaaccctaagggtttacttttaacccacccggttttaccctacccgtaaaccccgtaatttacccgtaaacggtttaaaccgtttccgtacggtaaccgttaaaaccgggttacgggtaaaacggttaaccgtttttaacggtacccgtttaaaccgttttaaacgtttaacccgtttacgttaacccgtaaaccgtaaacggttaaaacttttaaccgttaaacggttttaccgggtttttttaacccgggaaaccccgggttaaaaccgggggtaaacccgttaaaccccgggtaaacctttaaaccgtaaaaaaccgttttaaaaacccggaaccgtttacgggtacgggtacctacggtacccttaaccgtacgtttaacccgttaccggttacctttacccgtaaccgtttccccggtttaccccggtccgttaacctttccgttagttaacccg

SEQ ID NO: 142648 - DNA, 711 bp, Homo sapiens
  misc_feature: GYAE6OF02HJTRI.46.67.G01.1.454.CMB.1.raw
  modified_base (168)..(168): a, c, t, g, unknown or other
  misc_feature (168)..(168): n is a, c, g, or t
  modified_base (173)..(173): a, c, t, g, unknown or other
  misc_feature (173)..(173): n is a, c, g, or t
  modified_base (207)..(207): a, c, t, g, unknown or other
  misc_feature (207)..(207): n is a, c, g, or t
  modified_base (645)..(645): a, c, t, g, unknown or other
  misc_feature (645)..(645): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtcctntggtncctcatcagtgtgttcttcgtgggctcgggtcgnacgctccgagggacgggctaggaactacgtagttgggaagttcgtcctcgtctagttaggtgggtacggtttcctagttacacggtccgttctcgtacgaagtacggtcgacgtaccaacctatactcctcgaggacctacgccagtactaactcgttacgttttccagaagtagtcgtagttcgaggtacgaccgtacgtctacggacgtacggttactttacgttcgtggtacgcgaagtcggacgttcttaagttacgtagtttagtttacgggtagttcggttttattaccggacctaccggttataaccgggttccgggacgggtccgttacccggcccgggttaggggaccgttaacgggtacgttcggtaccggttacccgtccggtttacttacccgtccgtaccctacccgtaacggaaccggttcccncggtttcccggttaccccgttcccggacgtacccccgtcctaacccgtacggaaccgtcgtacccg

SEQ ID NO: 142649 - DNA, 924 bp, Homo sapiens
  misc_feature: GYAE6OF02J0CH1.46.67.G01.1.454.CMB.1.raw
tcagactagcagtacacgaccggtgctcgatttagagtatacatattgggtttgtcctcctgctggtggcagctcccagatgggtcctgtccctggtcgcaactgcaggagtcgggcccacgactggtgagtccttcggagaccctgtccctcacctggcgctgtcctcgtggtcgcctccattccgaggttagttggttttccttcggtgggggtaccttcgggggtacccggctaacggtcccttcccggaaggggggtaacggggtccttagggaaattaccgtaagggtttcggggaaagttcggttacctaccgttactaaggttagggttcgggtaagggttttaccccttaagtttaaccgaacggttcccggttacttcccgtacgaaaggtacggtacgtacggttacctaaccgtaagtaacttccgtacgttacgggaacctaccggttccgaacgtaccgtaaaacttccggttaaccgtttttccccgaaggtaaacgttacggtacggttaaacgtttccgtagttaaccgggtcccgaccggttacgttaacggaaccgggtaccgggtttaacgtttttaacccgtagttacggttacgtaaccggaaggtaaccggtacccggtttagttaactttaggttacggtttacgttttagggaagggtttttacgttaaccgttacggtaacctacccggttacgtacgggtacccgggtacgggtcctaccgggtaccccggttaggggaccgttaagggtaacttacgggtccgttaccggtacccgtttaccgttaaccgttaccgcccttaacccggaccggttaaccgggaccttcgggtaccgtttccccgttacccgtcgggtaacccttcccgtaacccgtacgttaccgaccttacccggg

SEQ ID NO: 142650 - DNA, 983 bp, Homo sapiens
  misc_feature: GYAE6OF02H8EFB.46.67.G01.1.454.CMB.1.raw
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggcccttcgggacgacccctcgtcccctccacctgcgtctgtcctcgtggtcnccctcatcgagtgtggttcttgngggtcgtgggtccgnacgccgtccggaaggggagggctaggaactagtaggttagaagtgtcctagtactaagtcgggtaggaccggttaccttaagttaccgtacggttccgttcctacgttaaccgaaaggtacgggttaccgtagtacccaacttattaccttcgtaccgttacgggaaccctaaccgtaccggaatacccgttaacgttacccgttttacccggtttttaccccgaaggtaaacgttaggttaaccgttaacgggttttcctacgggttacccgggacccccggtaccggttacccgttaccgggtaacccgggttaaccgggggttttacgtttttaaccgtacggttcggtaccgggaaccgtacgggtaacccgtacgggttaacgttaatttagggttacgttttaagggttttacgggttaaagttttcgggttttaaacctttaccggttaaacccgttaccggttaacggtaccggtaaccgggggtccgggtcccggttaaccccggttaccccggggtagggggtaaaccccggtaacgggttacggttaacccggggtttacggtacccccgtaaggtttaccccccgttaccggtaccccggttaccccctaacccggggttaacccggtaaaccccggggtaccccgttaccccgggtttcccgggttaccccccgtttaccccccggttaccgtaccccccggtaacccccgtttcccgaaacccggtacccggttacccggaccccgg

SEQ ID NO: 142651 - DNA, 792 bp, Homo sapiens
  misc_feature: GYAE6OF02FQTVE.46.67.G01.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtacacctntcacttggcccgggacaacggtcggaaactnttcgaactaaccttaatttaaagttggtatacaaacattacgaaccgagggaccggacccctaagccttacctaactctatcgctgacctatacctagtttacgaacgtaaacgggtcggggtaccctagttcggtacggtttacagggttcggctaagggttggtaatccggttaggggaactacggttaactttaccgaaccgttccttaccgaaccttactacgtaacgttaaacgttcctaaggtaccgtaaacgggttaacgtaaggtttaactttttacggaaccttaaacgtttaacgtttaaccgttacggtaactaaacgtaacgttaaactttaaaccgtaagttttccggttttaaccggaacgtaaaccgggtaaccgtaaccgaaccgttaaaacgtaaaaacgttaaaaccggtaaccgttaggttaacgggtacgttaccgtaacccgttaaaccctaacggtttacggtttaccccgttactttaccgttaccgtttcccgtttaaccccggaccctttacgttacccgtagttaacccg

SEQ ID NO: 142652 - DNA, 732 bp, Homo sapiens
  misc_feature: GYAE6OF02I84MX.46.67.G01.1.454.CMB.1.raw
  modified_base (280)..(280): a, c, t, g, unknown or other
  misc_feature (280)..(280): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctcccgagggaagggctggaatacagttggaagttgtctctcatagtggaggtttcctattacgngtccgtctctcaagtagtcgagttcactagtactctcgtggaccacgtccagcaatcgttacgttttccccnggaaactntacgtagttctcggttcgaacccgtccgcgtacggaaccgtacggggttacttttaacgttacgttggtcgtacggtagacggtaacggtcttaacgttagttaggtttagtttttgggtacggtttaggtttactttaccgtaacctacccgttaagtacggtaccgggaccggggtccgtacccggtaccccgggtcggggaccgtaagggtaacgttaccggttacggtcccgtacccggttccgtttacccgttaccgtcccctacccgtaacccggaacccggtaccctaacggttcccggttaccccgtttcccccgtacggtccccgtacccccgttcccgtacccggtagaccccgtaccccgg

SEQ ID NO: 142653 - DNA, 782 bp, Homo sapiens
  misc_feature: GYAE6OF02GVQJ1.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgccgctgtctcgtggtcgccctccatcagttaggttggtttccttcgtggggctcgggtccgcacgtcctcccgaggggaaggggctaggaactacgagttgggaagtcgtctctcgataggtggtagttcctattaccaggttccgtctcctacaagtcgtaggacgtcaccatcttcctcgtacggactccgttacacgtacaacttaccgtttacgttttccccgaggtaaagtacttggtacgtttccgtggtaccggtaaccccggcctacggtaccggtaaccggtaccgggtttaccgtttttaaacgttaccgttgggtacggtaccgggtaacggtaacgggtaccgttaagtttacgttaacgtttggtttaacggtttttcggggatttttaacggggtttaaccttttaccgaacccgtaacccggttaaggtaccgttaacccggggaccggggtttccctaaccccggggttccccgggtacggggaccccgttaaaggggtaacgttaccccggtacgggtttaccccgtaccgtttacccggtcccgttacggtcccccgtaaacccgg

SEQ ID NO: 142654 - DNA, 795 bp, Homo sapiens
  misc_feature: GYAE6OF02G0MKL.46.67.G01.1.454.CMB.1.raw
  modified_base (193)..(193): a, c, t, g, unknown or other
  misc_feature (193)..(193): n is a, c, g, or t
  modified_base (445)..(445): a, c, t, g, unknown or other
  misc_feature (445)..(445): n is a, c, g, or t
tcagactagcagtacacgaccggtgctcgatttagagtatacatattgggtttgtcctcctgctggtggcagctcccagatgggtcctgtccctggtgcaactgcaggagtcggccacgactggtgaggccttcggacgaccctgtccctcacctgcgctcgtctctggtgcctcatcagtagtggttctcgngggctgggtccgcagcctccgaggggaagggctagggaactacgattcgggaagttcgtctcgtacaagttaggtcggtacggttaccttaagttaccgacggttcccgttacttcgtaccgaaaggtacgttccggaacgttccaaccgtattacctccttacggtacggaacctaccggttaccgaaggaccttaagttccgttaaccgggtttttccccaaggtaaacgtagttacggtacggttttcngggttaccggacccggtccgtacgtaccggtaacgtaccggggtttcttttaaacgtacgtcggtacgtacggtacggacggtaccggtcttaagttagttacgttaagttttacgggtaggttacggtttacgttaccggtacgtacccgtacggtaccgtacgggtaccggggtcttacccggtacccggtacgggaccggtaagggtaacggttaccgttacggtacccgtaccggttaccgtaccgttaaccggcccgtaacccgtaccggtaaccggtcccgttaacggttcccgttacccgttcccgtccgtccgtcccctacccgttacgaccgtacgtcccg

SEQ ID NO: 142655 - DNA, 886 bp, Homo sapiens
  misc_feature: GYAE6OF02GFYK7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgagtgccagatgtgacatcgagctgacccagtctccatcctccctgtctgccaaccgtgggacacagtcgtacaccagtcctaacttggccccggggataaacggtaccgggaaactagtttcggaacctaacccgtttaaattttaaaacgttcggttaacttactaaaccaaattaacggaacccgtaaagggggtaacccggggtaacccccctaaagggtcccgtttaacccgtaaaacgttaccttaaaccgttaggtacccgtttcggaacctaaccgttaccccgttaaggtttaggtaacccgtaaaaacggggttccgggggttaaccccctaggttacccgggtaaggtttaacccggtaaagggttcgggacggtaaacgggttcggggtaacgttcggttacggggaacccgttaaaggttactttaacccggacttcccgttacccaaaccgttactaaccgtaaacggtttaactaccggtttacgaacccgttaaacgttacggtaaaggttattttaccggaccttaaacgttttaaccttacggttagtaaccgtaaactaagtaaacctttaacgttaaggttacgggttttaccggaacccgtaaacgggtaacctaaccggtaaacttaaaccggaaaatttaaaccggacttacggacgttactacggtacctaacgtacgttaccttgtacctttaccggattaaccccgttccgtactcccttagtacgtaaccg

SEQ ID NO: 142656 - DNA, 612 bp, Homo sapiens
  misc_feature: GYAE6OF02HLPAO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacatgacactatttaatgtatcacatagacaggacgcccctaagctactaatctatgctgcatccagtttgactaaaggtgggtcccagtcgtaggttcacggtgcgtaggtggatcgtagggacagtattcactctcaccatcagtaactctgacaacgtgaaatagttttagactaaacgtttatttactacgttacaaacttaagtaactttactaaagtttcgggttttaaccggacccgaaacgggtactaaccgtaaccttaaacgtaaaacgttaaaacgtaaccgtgttacggtacttacgacccgtaaccgtaacttccgttaagttcctttacggtacctttcccggtttacccgaccctacgttaccgtacgttaac

SEQ ID NO: 142657 - DNA, 645 bp, Homo sapiens
  misc_feature: GYAE6OF02G4B3K.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccggacaagtcggaactattgacctaccgttatttaaattgtatcaacatacgaccgagggaccggcccctaagctacctaatctatgactgcatccgtagtttacgacgtaacgtcggggtacccagttacgtaggttcgaggtggactaggtggatcggtaggactaggtacttcgacttctaccactatacagtaatctagtacgtacgtagtaacttagtttcgaaccttaaactttattaacgtagttaacaaacgtaagtaaatttactaagtttcgtttaaccggaaccgtaaacggtaacctaacggtaaacttaaacgtaaaacgtttaaaaccgtaacttaggtaacggttccgagtacctaacctacttcgtacgttccttacgttacctttcccgtaccccgtactaccgttctacgtaac

SEQ ID NO: 142658 - DNA, 835 bp, Homo sapiens
  misc_feature: GYAE6OF02HJCKM.46.67.G01.1.454.CMB.1.raw
tcagactagcagtacacgaccggtgctcgatttagagtatacatattgggtttgggggagtctcggtcaggacacagcatggacatgaggtcccgactcagctctgggctcctgctactctgctcgaggtcgccagatgtgacagtcgagctcgacccagtctccgactcccttcccgtgtctcgaccgaaccggtgggacgacacgtcgtccacctacgtccgtaaccgttcggcccgggtactaaacggttaccgggaaactacgtttacggaacctaacccttaagttttaaacgtacggtaactaaccaaactacgtaacggaccgaaccggggacccggacccctaagtcctacctaattacctaagtacgtcttacgactacgttccgtagtttacggactaacgggttcgggtaccagttaccggtaggttacgaggtacggacgtaggtcgggtagtaccgtagggtacctaagttacgtttccctaaccgtttccacccgtaacctactaccgtaaagttaaccgttctaacggaaccgttaaaccgggtagttaaacgtttacgttttacgtaacgtttaaacctttacgttacgttacgttaactaaaccgttataaactttaccgttaagtttaccggtttaccggaacgtaaaccggtataacccgtaacgttaaaactaaaagggttaaacccaggttaaccgttacggtaccgtacggtaaaccttaccgtaacgtttaccgttaccggttaacccgttacctaccggttttaacccccgtacccgttaccggttttaaccgtccgtaagtttaacccgg

SEQ ID NO: 142659 - DNA, 671 bp, Homo sapiens
  misc_feature: GYAE6OF02H4PCW.46.67.G01.1.454.CMB.1.raw
  modified_base (258)..(258): a, c, t, g, unknown or other
  misc_feature (258)..(258): n is a, c, g, or t
  modified_base (296)..(296): a, c, t, g, unknown or other
  misc_feature (296)..(296): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgaccgaaccggtggagacaggtgtcacatctacttcgccggcaagtcgaactatgacaacgtatttaaatggtatacaanatagaccgagggaccgaccctaagcctacgtaatctancgtcgtacgactacgttaccgtaggtttacgacgtaaacgggttccgggacccagttaccgtaggtttcgaaggtggacgtagtggacgtcggtagggactaagtctttacaccgtctacctaccaactttacgaacgtttaactaccgtagtaccgaaacgttacggtaattacgtttacgacttaaccgtttattaaccgttacgtaactaaacgtaataaacgttaactaagttccgtttaagggacccgtaaagggaccttaacgtaacttaaactaaaaccgttaaacggaacgttgtacgtacgtacgaacgtaactacttcgtacgtttccttaactacgtttccgccctacctacgttacctatacg

SEQ ID NO: 142660 - DNA, 1019 bp, Homo sapiens
  misc_feature: GYAE6OF02HLM8M.46.67.G01.1.454.CMB.1.raw
tcagactagcagtacacgaccggtgctcgatttagagtatacatattgggtttggggagtctcggtcgaggacacagcagtggacagtggacgggtccccgctcagcctccggtggggcctcctgcctactcgtggcctccggaggtcgaccagtatggtagactacgtcggacgcgtaccgaacccgtacgttccctaccctaccttccccgttcccgttgttcctcggaacccgtaaccgggtggggaactaacgtaggttcgtaccaaccctacttacctaccggttccggggacccgggtaacgtaaacgggttaaccggaaacttacgtttaccgaaacccctttaaacctttttaaaagtttttaaaacggtttacggttaaccttaaccgaaaaccttaaacggttaaaccggtaaccccggggaaaccggggggacccccggttaaaccccccgttaaacggtccccctttaaacccgttaaacttacccttaaggttccgaccgttaccggtacctaaccgttacccggtttaggtttaccggaaacggtaaacggggtttccgggtaccctaggtaccgggttacggttacggaggtcggtacgtaggtacggtactcgggtacggaacgtaacggtttacttaccgtaccgttacctacccgtaactaacgttaccgtaaagtttactccgtaacgtaacgtaaacggtaggttaaactttagtttaccgtaaacctttaacgtttaacgttacgttacgtaaacccgtaaagttaaacgttaaactttaagttttaaccgggttttcggtttaaacccggggtaaccggtaaacgggtaaccgttaaaccgtaaaccgttaaaaaccgttaaaaccggttaaaaccgaacggtttcgggacggttacccgtccggtaaacccctacgttacgtttacgttaccctttacttaaccgtttacccgttaaccccgttccctacctttacgttaccgtaacttaacccgg

SEQ ID NO: 142661 - DNA, 790 bp, Homo sapiens
  misc_feature: GYAE6OF02JNB5L.46.67.G01.1.454.CMB.1.raw
  modified_base (138)..(138): a, c, t, g, unknown or other
  misc_feature (138)..(138): n is a, c, g, or t
  modified_base (149)..(149): a, c, t, g, unknown or other
  misc_feature (149)..(149): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtncaactgcaggngtccgggcccacgtactgggtgacggtccttacgggacgtaccctcgtccctcaccgtggccgcttcgtctcgtggtccgccctaccatccgagttgttcggtttctcggtggggcttcggggtacccgctacgtccgtaccccggaagggggtacggggccttaaggaacttacgtaagttacgggaatttggtcctctttacgatttacgggtgggtacgtttaccgtattacgtaccggttccgttacttcgtacgtaaggtacgtcgtacgtacctaaccgtatacgttactcggttaccggaaccttccggtactaacgtaccgttaacttccgtttaccgttttaccgaagacggttaactcgtttacgttcgtaccggttaccggaccccggtccgtccgttaacggaaccggtacggggttctttaactcgtagggtcaacggtaggtacgacgttacgttattggttatttacggtttacgggtatttacggttacttactaacccgtacggttacgtacggtccggggtaccgggtaacccttcccgggacccgggttacggacggtaaccggttacgtccgtaccgggccttacccggttaggttccccgttacggaccccctaacccgg

SEQ ID NO: 142662 - DNA, 673 bp, Homo sapiens
  misc_feature: GYAE6OF02IJO4J.46.67.G01.1.454.CMB.1.raw
  modified_base (181)..(181): a, c, t, g, unknown or other
  misc_feature (181)..(181): n is a, c, g, or t
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcgganaccctgtccctcacctgcgctgtctcgtggtcncctcatcagtagtggttcttcgtcgggtcggtcggtccggcncgccgtccgacgggagggacggtcgaagtactagtaggtaagtcgtctctcattagtgggtacggttccgttactacgtacgtcgtccttacncgaacgtagtcgacgtccacgtatactcgtctcgtaccaccgtacacgtacgacttacgttcgtttaccgttcggaaagtactagttagttacgttcggtacggccgaccgtcgtagacgtacgggttacgtttacttagtgtacggtagacggtacgacggtacttaagttacgttaggttaacgttttggttacgggttagtttttacgttaccgttaaccgaccgttaaccgtgtacccgggtacgggtaccggtcccgtaccggtaccgggacgaacgtagtacgtcggtcctaccggtcctacggttccgacctacccg

SEQ ID NO: 142663 - DNA, 729 bp, Homo sapiens
  misc_feature: GYAE6OF02JAXXL.46.67.G01.1.454.CMB.1.raw
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (510)..(510): a, c, t, g, unknown or other
  misc_feature (510)..(510): n is a, c, g, or t
  modified_base (682)..(682): a, c, t, g, unknown or other
  misc_feature (682)..(682): n is a, c, g, or t
  modified_base (720)..(720): a, c, t, g, unknown or other
  misc_feature (720)..(720): n is a, c, g, or t
tcagactagcagtacacgaccggtgctcgatttagagtatacatattgggtttggggagtctcggtcaggacacagcatggacatgagggtccccgctcagctcctggggctcctgctactctggcctaccggaggtgccagatgtgacatcgagctgaccctagtctccatcctcctgtctgcaaccggtgganacngtgtcacatcacttcggccggataaggtaccggaactattacgaacctaccttaaagttttaaagttggtaactaccgaaacgtacgtaacggaacccggtacggggaacccgtacccccgtaaagccttaaccctaagttaccgttaagttcggaccttcggtacctacgttacccgtaagtttacggaacgtaaacgggttccgggtaccctagttacggtacgggttctacgggttacgacgtagggtacggtacttacggtacggggtaactacggttactttaccgacctttacgaccgtaaacgtntaccgtaagttactcgtacgtaaccgtaacggtagttaaacgtttcgtttacgtaaccttaactttacgttaacgttacgttaaacaacgttaaggtaactttacgttaacgtttcggttaacggacgtaacgtaacaccgtaactaactaaagtaacgtacgtagtaccgntacgactctaagtctacgtactatcctcctccaacgtntcgtatacg

SEQ ID NO: 142664 - DNA, 673 bp, Homo sapiens
  misc_feature: GYAE6OF02FZRZR.46.67.G01.1.454.CMB.1.raw
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctggaatacagttgggaagttgtctctcagtagtggtaggttcctattacagtccgtctctacaagngtcgagtccaccatactctacgtcggacacgtccagacaatctacgttttccagaagntgacgttctgtcgaccgcgctacgacgacgggttcttttatacgtgtgacgagagacggtacttaagttagtagttagtttttagggtaggtttaggtttacttacgtaccgtaacccttaaggtacgttaccgggtaccgggggtcctacccggtaccccggtacggggaccgaagggtaacttacggtcggtaccgtacccgttccgttacccgttacgacccgttacccgaacccggtaaccgggcccgtacttcccggttcccgttccccgtcggtacccctaccccgtcccgtaccgaacggaccgtacccg

SEQ ID NO: 142665 - DNA, 684 bp, Homo sapiens
  misc_feature: GYAE6OF02GWJJ0.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctagtggcagctcccagatgggtcctgtccctggtgcaactgcaggagtcgggcccacgactggtgaggccttcggagaccctgtccctcacctgcgctgtctcgtggtcgcctccatcagtagttgtttctcgtgggctgggtccgcngcctccgaggggaggctaggaatacagttggaagtgtcctctcagttggtggtacggtttcctattaccgcgttccgtcttctacgaagtacgtcgacgtccacctatactctcgtgacctacgtccagactaatcttacgtttccagaagtagtgtacttcgtgaccgaccgcgtcgtacgacgtacggggttcttttaacgtcgtggtcgacgtaggacgtacggtcttaagtttgttacggtttagttttagggtagttttaggtttaaccgtttccggtaacctaacccgttaggtacccgggttaccggggtaccggggtaccctcccgggtaacccccgggttgggggaacccgtaaggggttaccttacgggttccggtacccgttccccggttacctttcccggttaccgcccccgttaacccgg

SEQ ID NO: 142666 - DNA, 795 bp, Homo sapiens
  misc_feature: GYAE6OF02GF1SF.46.67.G01.1.454.CMB.1.raw
  modified_base (192)..(192): a, c, t, g, unknown or other
  misc_feature (192)..(192): n is a, c, g, or t
  modified_base (437)..(437): a, c, t, g, unknown or other
  misc_feature (437)..(437): n is a, c, g, or t
tcagactagcagtacacgaccggtgctcgatttagagtatacatattgggtttggggagtctcggtcaggacacagcatggacatgagggtcccgctcagctcctggggctcctgctactctggctccggaggtcgccagattgtgacatcgagctgaccagtctccatcctcctgtctgcaacggtggganactagtgtcaccgtatccgtacttggtacgggactaacggtcggaactagttacgactaaccttaattttaaacgttcggtaatacaactagtaacgaccgaagggtaccggacccctaagtcctacctaacgttctaatacgtacgttacgcctaattccgtagttacgaacgtaaacggtcgggtaccctaggtacgttacggttcgacggtggacctaggttcgaacgtcggtacgggtaanacgttacttaccgtacttacctacgtaccgtaattcgttaagtacgttacgtacgtaccgtaaacggtagttaacggttacttttacgggtaccttaaacgtttacgttaccgttaagtaacccgttaaactacggttaaacttaaccttaaggggtttaccgttttaccggaaccgggttaaaacggaccgttaaccgtaaaccgtttaaaacgttaaaccgtttaaaagtaccgtttaacgggtaccgttagtaacctaccgttaacgtaccggttttaacgttaccgttaccgtttaccgttaaccgttaccccggttaacccgtaacgtttcccgtttaacgtgtttaaacccg

SEQ ID NO: 142667 - DNA, 686 bp, Homo sapiens
  misc_feature: GYAE6OF02H72PS.46.67.G01.1.454.CMB.1.raw
  modified_base (287)..(287): a, c, t, g, unknown or other
  misc_feature (287)..(287): n is a, c, g, or t
  modified_base (339)..(339): a, c, t, g, unknown or other
  misc_feature (339)..(339): n is a, c, g, or t
  modified_base (430)..(430): a, c, t, g, unknown or other
  misc_feature (430)..(430): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagcctccgagggaagggctggaatacattggaagtgtctctcatagtggaggttcctattacagtccgtctctcaagngtcgagtcacctatatctcgtggactacgtccagacaatctacgttttcccngtaacgtatgagtttctgtcgacccgccgtctacggaccgacgggttcgttttagttacgtaggttcggacgtaaggtacgggaaccggtnttaacgtttagttggtttagtttttacggggtaaggtttgggttttacttttaccggaaccgttacccgttaaggtacggttaccgggaccggggggtccttccgggacccccggtagggggacccgaaggggtaacttaccgttcgggtcctacccgtccgttacccgttaccgtccctaccgaccggacgggcccctaggtcccgttcccttcccccgtggccctaccccttcccgtaccaccggtataccccg

SEQ ID NO: 142668 - DNA, 604 bp, Homo sapiens
  misc_feature: GYAE6OF02HRN7L.46.67.G01.1.454.CMB.1.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacnttgacactatttaaatggtatcaanatanacaggacgaccctaagctcctaatctangactgcatccagtttgacgaaggtcgggtaccctatcggtaggttcagtcggcaggtgactcgtgggaacagtactttcacgttcacaccatcaagtaactcgtagactaacgtagtaagtattttacgacttaacgttacttaactacgtaactaaactaagtaaattaactaaacgttacggtttacggaccgtaaaggtaacgaaccgtaacgttaaactaaaacgttaaaacgtaacgttacgtacgtacgttacgaacgtaactacgtacttcgtaacctttcgacttaccttcccgacctactacctagtaacg

SEQ ID NO: 142669 - DNA, 639 bp, Homo sapiens
  misc_feature: GYAE6OF02H4NH0.46.67.G01.1.454.CMB.1.raw
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgacacgtgggagacagtncacatcatcgccggnaagtcgaacntgactacttattaatgtatcaanatagaccgaggaccgcctaagtcctcctaatctatcgctcgctactactgtttcgacgtaaacggtcggggtacccagtacggtaggttcgaggtggacgttaggtggtacgtgtacgggtacgtaggtactttccaccgttcctacctacctagtacctaagttaactcgtcggtactaacgtacggtaaattacgttttagactttaaactttcttaacgttacgaacgttaactaacgttaacttaagtaacgtttacggtttaccggaaccgtaacgggtaacctaaacgtaaccgttaaaactaaacgttaaacggtactagtaccggtactaccgacctaacgtcttacgtattacctcttactcccgttacctcctatctataacg

SEQ ID NO: 142670 - DNA, 893 bp, Homo sapiens
  misc_feature: GYAE6OF02JMDW3.46.67.G01.1.454.CMB.1.raw
  modified_base (253)..(253): a, c, t, g, unknown or other
  misc_feature (253)..(253): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtagttggtttcttcgtgggcgtgggtccggcagctccgagggagggctaggatacagttggagtgtcctntcataggtggtacggttctattacgtacgttccgtctctacgaaggtacggtcgtacgtacctaacctatacttctcgtacggaacctaccggtccaagtactaagttccttaccgttttaccccgtagtaaagtcgttacggttacggtttcgttacggtacgtacccggtcccgtcgtacggtaaccggtacgggtttactttttaacttaccggttgggttacgacggtagggtaacgggtaaccggttacgtttaaagttttacggtttacggtttaacgggttttttaggggttaacgggttttacgggtttttaacgtttaacccgggtaaaccccgttaaacccggtttaaacggttaaccgggttcccgggggtaacccggggggttacccgttaccccggggtaacccccggggtttaccgggggaccggtaaacggggtttaaaccgtacgggtttaccgggttacccgtaacccggtttacccgttacccgttaaccgggttcccctaacccggtaaccgggtaacccgggtacccttaccgggtttccccgggttaccccgtttaccccgtcccgggtaccccttaccccggtaccccgtaacccggtaccggtaccggtacccccgg

SEQ ID NO: 142671 - DNA, 726 bp, Homo sapiens
  misc_feature: GYAE6OF02H83JI.46.67.G01.1.454.CMB.1.raw
  modified_base (199)..(199): a, c, t, g, unknown or other
  misc_feature (199)..(199): n is a, c, g, or t
  modified_base (330)..(330): a, c, t, g, unknown or other
  misc_feature (330)..(330): n is a, c, g, or t
  modified_base (397)..(397): a, c, t, g, unknown or other
  misc_feature (397)..(397): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
  modified_base (709)..(709): a, c, t, g, unknown or other
  misc_feature (709)..(709): n is a, c, g, or t
  modified_base (721)..(721): a, c, t, g, unknown or other
  misc_feature (721)..(721): n is a, c, g, or t
tcagactagcagtacacgaccggtgctcgatttagagtatacatattgggtttggggagtctcggtcaggacacagcatggacatgagggtccccgctcagctcctggggctcctgctactctgctccgaggtgccagatgtgacatcgagctcgacccagtcctccactccctccctagtctcgacaaccgtggacangtcgcacatcacgttggcccgagtaacgtaccggaatcttacgacctaccgttaatttaagttacgtactaccaaatacgtacggaaccgtacggggaccgacccctaaacggtcctaactaactcttaancggcctagctacgaccttggttacgaaccggtaaggtccggcctagttccggaggtacgtaggacgntcggtagtcacggtggaattactacttaccncgttaccnctaaaccgtntacgtaagtacgtctacgaaccgtaacgtagttaagttaactttacggtaactttaacttaggtttaaccgttagttaaccctaaggttaaacgtaaccgtttaaaggtttacctttaacgggttacccgtaaacggttaaacggaaccgtaaacgtaacctttaaaacgttaaaaccgtaaaccgttacgtacgtacgtacgtagacccgtccgtaacttccgtacgttacttaaccgttcggttacccttccgaaccgttnttaaccccgttntaccg

SEQ ID NO: 142672 - DNA, 600 bp, Homo sapiens
  misc_feature: GYAE6OF02G13SK.46.67.G01.1.454.CMB.1.raw
  modified_base (249)..(249): a, c, t, g, unknown or other
  misc_feature (249)..(249): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgnagcctcccgagggaagggctggaatacagttggaagtgtctctcagttagtggtacggttccttagttaccgagttcccgtctctcaaggtcgtcgagtaccacctatacttctcgtaggactacgtccagcaattctacgttttcccngaagtnttgtagtttctgtcgacccggtccgcgtacgaccgtacgggtcttttagtaccgtgttgcgaagacgtacgtctattagtgttattttggagtttgttagtttcgaccgtacctagcgtcgggacgggtctaccggcccggtgggaccgagggtaactcgtacggtccgtaccgtccttacgttcgccctacccgg

SEQ ID NO: 142673 - DNA, 769 bp, Homo sapiens
  misc_feature: GYAE6OF02H680C.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttggacgaccctgtccctcacctgcgtctgtctcgtggtcncctccatcgagttcgttgtttctcggtcggggtcgttgggtccgctacgccgtaccggaggggaacgggtctaggtaactacgtaggttggtaacgtcgttacctacgtcagttacggtgggttaccggtttacctagttacgtacggttcccgtctactagaacgtggtacgtagtccaactatactctccgtagacctcgtacagtactaactcgttactttacaggtactagtcgtagttacgtcggtaccggccgtaccggtctaccgggttaccggtaccggggtttaccttttaacggtacgttcgggtaacggaccgggtaaaggtaccgttacggtactttaagggttcgtttaaggttttaggttttacggtacgtttggttttaacctaacccggtaccttaccggtacggtaggttaccggggacccggggtttcccgtaccccgggttaccggggaccgggtaaccggtaacgggttaaccgtacggttcccgggtaccgttacccgttcctaaccccggttacctcccccggttaaacccggg

SEQ ID NO: 142674 - DNA, 677 bp, Homo sapiens
  misc_feature: GYAE6OF02I8363.46.67.G01.1.454.CMB.1.raw
  modified_base (213)..(213): a, c, t, g, unknown or other
  misc_feature (213)..(213): n is a, c, g, or t
  modified_base (667)..(667): a, c, t, g, unknown or other
  misc_feature (667)..(667): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcncctcagtctagtagtcgtttctcgtggggctcggggtccgcacgccgtcccgaggggtaacgggctaggaatacgattaggaatcgtactctacatagtgggtacggttcctattactacggtccgtctacgtacgaaggtgtccggagtcgacctatacttccgtcgttaggaccttaccgtccacggtactaactcgttacgttttcccgaagaagtacgtcggtacgttttctacggttccgaacccggtccgtaccgtcggtaaccggtaccggggttattttaacgttacgtggttacgaggacggaggaccggtattaacgttagttacgtttagttttcgggaagtttcggtttacttaccgaaccgtaccgttagtacgtccgggaccgggtctaccggcccggttgggaccgtacggtatcggtgtcccgaccgttccttccgtntaccctaccg

SEQ ID NO: 142675 - DNA, 957 bp, Homo sapiens
  misc_feature: GYAE6OF02IR9P7.46.67.G01.1.454.CMB.1.raw
tcagactagcagtacacgaccggtgctcgatttagagtatacatattgggtttaggtcctcctgctggtggcagcgtcccagatcgggtcctgtccctggtgcaactgcacggagtcgggcccacgactggtgaggccttcggagaccctgtccctcacctgcgctgtctctggtcgcctcatcaggtcgttcggtttcttcgtggggtcgtacggggtccgctacgcctacccggaggggaacggggctagggaaacttacgtaggttacggaaggttcgttacctctacgtaagttacggttagggtaacggtttaccgttaacgtttaacgtaacggttccccgtccgttaccgtaccgaaacggttacggttacggtaacggttaccgaaccctaacgttaacttccgttaccgttacggtaaccgtaaccgttccccgacgtaaccgtaaacttaccgttaccgtttttttacccccgaggtaaaacgtacgttacggttacggttttaccttcgggttaccggacccggtcccgtacgttacgggaaccgggtaaccgggtttaccgttttaaacgtttacgttcggttcgggacggtaacgggtaacggtaccgggtacttttaacgtttaacggttagttttacggtttttaagggtaacgggttttgggttttaacgtttaccggttaaacccgtaacccgtttagggtaacgttacccggggtaacgggggtacccttaccgggtaaccccgggtacggggtaacccggtaaagggttacgttaaccggttcggttaacccgttacccggttccgttaaccgttacccggtacccgtacccggaacccggttaacccgggtaccctaccgggtttacccggttaccccctttcccggcccggtacccttacccccgttacccgtaccggtaaccgtccggtaccccg

SEQ ID NO: 142676 - DNA, 679 bp, Homo sapiens
  misc_feature: GYAE6OF02HCP6D.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaaggtcggaacattgactaccttatttaaattggtatcaacatagaccgaggacgccctaagctcctaatctatgctgcactctagtttagactaaaggtcgggtaccagtcgtaggttcgagtggcagtggatcgtgggactagtactttcactctacacctatactagtaactcgtagacgtaacgtagtaaattacgttttagaaccttaactttatttaaccgttcgttaacaaacgtaagttaaactttaacgtaagttttcggttttaccgggaaccgtaaacggggtaaccctaacggtaaaccttaaaccgttaaaaacgtttaaaaccgtaaacgtttcggttaacggtaccttaacggtacctaacccgttactttaccgttacgtttacccgttaccttaaccgtttccccgtttaccccgacccgtttacgttaccgttacgttaaccg

SEQ ID NO: 142677 - DNA, 786 bp, Homo sapiens
  misc_feature: GYAE6OF02INK8C.46.67.G01.1.454.CMB.1.raw
  modified_base (209)..(209): a, c, t, g, unknown or other
  misc_feature (209)..(209): n is a, c, g, or t
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
tcagactagcagtacacgaccggtgctcgatttagagtatacatattgggtttgtcctcctgctggtggcagctcccagatgggtcctgtccctggtgcaactgcaggagtcggccacgactggtgaggccttcggagacccttgtccctcaccgtgcgctgtctctggtcgcctccatcagtagtgttcttcgtggggctgggtccgnacgctccgagggagggctggaatacagttggaagtgtctcacagtaggtggaacggtttcctaatttacgagttccggtctactacgaaaggtagttcgagtaccaaccgattactcttagacggaactacgtccaagcctaaagttcttacgttttacccgagaaagtatcggtaatttccgtggtgaacccgtccgntacggaccgaggggttacttttaacgttacnggtacgacgtaagacggtaaccgggtnttaagtttaacttaggttactttttagggaacggtttggtttaactttacggaaccgtaacccgttaaggtacgttaccgggtacggggaccttacccggtaccccgggtacggggacccgtaaggggtaaaccttaccggtacggttacccgtaaaccgtttccgttacccgtttaaccgtcccgttaacccggaacccgggtaaaccgggtaccccctaacggttcccggggtttaaccccctttccccccgggttacggtaacccccggtaccccccttaccggttaaccccggtaaccgggaccgttaaccccggg

SEQ ID NO: 142678 - DNA, 836 bp, Homo sapiens
  misc_feature: GYAE6OF02IQ2FE.46.67.G01.1.454.CMB.1.raw
  modified_base (193)..(193): a, c, t, g, unknown or other
  misc_feature (193)..(193): n is a, c, g, or t
  modified_base (827)..(827): a, c, t, g, unknown or other
  misc_feature (827)..(827): n is a, c, g, or t
tcagactagcagtacacgaccggtgctcgatttagagtatacatattggggtttgggggagtctcggtcaggacacagcatggacatgagggtccccgcctcagctcctggggctcctgcctactctggctccgaggtgccagatgtgacatcgagctgacccagtctccatcctcctgtctgcaccgtgganacagtcgcaccactcacgttcgaccgggcaaacgtccgggaactagttacggaacctaacccgttaaattttaaacgttacggttaacttacctaaaaccgtaaagttaaacgggacccggtaacgggggtaaccccgaccccccgtaaggtacccttaccgtaaacttcgttaacttcgggccttaacggctaacgttccccgttaagggtttcggtaaacccgtaaaacggggttccgggttaaccccctaagggtttacgggacggttttaccggtaacggttcggggaacctaaggggttcggtaaacgttccgggttacggggtaacctacggtttacgtttaccacgtctaacctacccgtactacgtaagtattaccgttacgaacgtaacggttgtaaacgttagtttaccgaacgtttaaaccctttagttactacggtaactaacggtaactttaaccgtaagttaccgttaggtttaacccggaacggtaacggtaccgtaacggtaacttaacggttaaaactaacggtaacgttacgggtcgtaacgtggaaccttaaccggtacttacggtaccttaccgtttacctaacggttccccgttaccctacggtactttacgnggttaaacc

SEQ ID NO: 142679 - DNA, 676 bp, Homo sapiens
  misc_feature: GYAE6OF02FYHXH.46.67.G01.1.454.CMB.1.raw
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctccaggggaagggctggaatacagttggaagtgtctctcagtagtggtaggttcctattacagtccgtctctacaagagtcgagtcaccatatctcgtgacacgtccagacaatctacgttttcccagaagtntgtagttctgtcgaccgtcgtctacggacgtacgggttacgttttactacgttgtacgcggaagacgacggtacttagtttacgttagttacgttttaggagtttaggtttacgtttaccgaaccgtacccgttaggtacgtaccggggtaccggggtccttacccgggtaccccgtcggggaccgtaaggggtaacgttccgtaggtccctaccggttctacccgttactccgtacccgaacccggtaccggtcccgaacggttccccgtttcccttcccccggtcggtaccccgtaccccttcccgtaccgtaaccggcgtaaccccg

SEQ ID NO: 142680 - DNA, 716 bp, Homo sapiens
  misc_feature: GYAE6OF02GSGX1.46.67.G01.1.454.CMB.1.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtgggctgggtccgnagctccgagggaggctaggaactacagttggaatcgtctntcatgtggagttcctattacacgtccgtctctacaagagtcgagtcactatatctcgtcgacacgtcagacaactctacgtttccagtaantagtagttcgtgtacgaccgtccgtctgacgtacgggtcttttaatacgtcgtgacgagacggtacggtacttaagtttagtacggtttagtttttacggaaggtttacgttttaacgtttaccgaacccgtaaccggtttagaccggttaccgggacgggggtcctacccgggtacccggtacgggggaccgaaaggggtacgtttaccggttacgtcccggtaacccggttccttaacccgttacggtccccttaacccggtaaccgggtaaccccggtaccgttaaccggttccccggttaacccccgtttccccggtaccgggtaccccttaaccccggttacccgaacccgtaaaccggtccgtaacccccgg

SEQ ID NO: 142681 - DNA, 636 bp, Homo sapiens
  misc_feature: GYAE6OF02HN6I5.46.67.G01.1.454.CMB.1.raw
  modified_base (598)..(598): a, c, t, g, unknown or other
  misc_feature (598)..(598): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtccaccatcacgtttgcgggacaagtcgaacattgacactatttaattgtatcaacatacgaccagggacgcccctaagcctactaatctatgctgcacgtcctagtttcgacgtaaggtcggggtacccagtcggtaggttacgaggtggacgaggtggtagtcgtaggggactaggtactttcaccgtctacgaccaattcgaagttatccgtgacctaacggtagtaagttagtttacgtacttaaatttacgttacttacgttaaccaactaacgttaattaaacctagtttacggttttaccggaaccgtaaggtaccaacgtaaccttaaacgtaaaacttaaacgaacgttaggtaggtcttagacctaccgttaactcgttacgttaccgttntacctttcccgttacccgccgtatttccgtagtaaccg

SEQ ID NO: 142682 - DNA, 685 bp, Homo sapiens
  misc_feature: GYAE6OF02FKBXS.46.67.G01.1.454.CMB.1.raw
  modified_base (356)..(356): a, c, t, g, unknown or other
  misc_feature (356)..(356): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaccgtgggagacagtgtcaccatcacttcgccggacaacgtcggaacattgactaccttatttaattggtactcaacatacgaccagggaccggcccctaagctacctatctagtcgctgctactccgtagtttgactaaggtcgggtacccagttcgtacggttcaggttcggntaggtagatcggtagggaactagtactttccgattcctaccacctacgtcgtaacgttaacgtccgtgaccgtaacgtagtaaacgttactttacgtaaccttaacttagttacctcgtaacctaagtacgtaacgttaaccttagttacgtttaccggaacgtaaccggtaacgtaaccgtaacgttaaacgttaaaaacgtaaacggtaaaccttagggtacgtaccgtacgtaacccgtaaacccgttacttaccggttacgttaccgtttaccgtacgttaccccggttacccgttaaccgttcttacccggttacgttaaccgg

SEQ ID NO: 142683 - DNA, 733 bp, Homo sapiens
  misc_feature: GYAE6OF02JYGZK.46.67.G01.1.454.CMB.1.raw
  modified_base (199)..(199): a, c, t, g, unknown or other
  misc_feature (199)..(199): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctggacccagtcctccatccctccctgtctcgccgaaccggtggganacagtgtccaccatcacgttcggcccgggacaacggtcggaacattacgacctaccgttaattttaaacgttggtacttacaactataacgaccgaacggggaccggacccctaagcctacctaatctatcgctcgactatcctagttcgactaaggtcgggtacccaagtcggtacggttcgnggtacgcgaggtgagttcggagggactagtacttcacctctaccaacagtacgtagttaactcgtacgtacgtaacggttagtaattcgtttactaacctttaactttaacgttaccgtagttaaacccacgtaaagttaaaccgtttaacgtaacgttttaccgggtttaacccgggaacggtaaaaggtacccgttaaacccggtaactttaaaaaccgttaaaacttaaaaccgggttaacgttaacgggttacggacttaaccgtaaccgtaacttaacgttcgtttacgtaccgttttacaaccgttttccccggaccttaacgtacgttaccttacggtaaacg

SEQ ID NO: 142684 - DNA, 735 bp, Homo sapiens
  misc_feature: GYAE6OF02G7QYR.46.67.G01.1.454.CMB.1.raw
  modified_base (210)..(210): a, c, t, g, unknown or other
  misc_feature (210)..(210): n is a, c, g, or t
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctcgtggtgcctccatcagtagtgtttcttcgtgggctgggtccgnagctcccgagggaagggctggaatcagttggagtgtctctcagtagtggtaggttctattacagtcctctctcaagntcgagtcaccatatctctgacncgtcagcaactcgtacgttttccctagaagtntaggtcgtttctggtacgtaccgcccggtcgtacgaccgtacgggttccgtttttaactacgttcggtagacgacggtaacggtacgggttacttaagtttacgttaggttacgttttttagggagttttcgggtttaactttccggaacccgttaaccgttaggtaccgttaccggggtaccgggggtacccgttacccgggaacccccgggtttcggggaccgtaaacggggtagttaacccggtgggttaaccccgtacccggttcgttacccgttaccggtccctacccggaacccggtaaccgggtcccggttaacgttcccggttacccgttcccccgtacgggtccccttaaccccgttccctaccggaacggtaccgtacccccgg

SEQ ID NO: 142685 - DNA, 728 bp, Homo sapiens
  misc_feature: GYAE6OF02H3ZU3.46.67.G01.1.454.CMB.1.raw
  modified_base (212)..(212): a, c, t, g, unknown or other
  misc_feature (212)..(212): n is a, c, g, or t
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtccctcacctgcgctgtctctggtgcctccatcagtagtggtttcttcgtgggctgggtccgcngctcccgagggagggctggatacagttggaagtgtctctcatagtggtaggtcctattacgagtccgtctctacaaggntacggacgtccaacctagtatcctcgtcggaacaccgtccaagacaacttccgttacgttttacccctggaaacgtagtagtaacggttcgtaggtcgtaccccggtccgtccgtacgaaccgtaccggggttactttttacgttaactggttcgacgtagtacggtaccggtactttagttaattacggtttagttttaggtaggtttaggtttacgttttaccgtaacctaacccttaggtaccgtccgggtacggggtcccgtccgtaaccccgggtggggacccgtaaggaacgttacgttccgggtccaccgttccgttacccgttacgtccccttaccgaacccggaaccggtcccgtaccgttcccggttaccccgtttcccccgtacggtcccctaccccgttccctaaccgtacccggacgtaccccg

SEQ ID NO: 142686 - DNA, 600 bp, Homo sapiens
  misc_feature: GYAE6OF02FHERR.46.67.G01.1.454.CMB.1.raw
  modified_base (299)..(299): a, c, t, g, unknown or other
  misc_feature (299)..(299): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaggggctggaatacattggaagtgtctctcatagtggaggttcctattacagtccgtctctcaagagtcgatcgaccntactctctgacacgtccagcaatcacgttttccctagaagatggattctgtcgtacgccgctgacgacgggtctttatacgtgtgcgagagacgctatatgtagtttggagttgttagttcgtacaccttagacgtcggacggggtcctccggacccgtgggaccgtagggtaactaccgtgtaccgtaccgtccttaccgttacgtccctccaccgtaaccgggcccacggttcccggttacccgtttcccccgtacgggtaccctaacccccgtcccgttaaccgacgtacgtaccccg

SEQ ID NO: 142687 - DNA, 618 bp, Homo sapiens
  misc_feature: GYAE6OF02F6ZIX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctgggaatacagttggaagttgtactctcatagtggaggttcctattacagtccgtctctcaagagtcgagtcaccatatctctggacacgtccagcaatcagttttcccctgaagatgagttcgtgtcgaccgccgctgacacggggtctttacttacgtgtgcgagagcggctattatgtagttttggagttggttatttcgactacccgtagtactcggacggggtcctaccggtaccccgtggggtacccgaagggtaactacgttcgggtcctacccggtcctccgttacgtcccttacccgaacccgtaaccgggtaccctacgtcccggttcccttcccccgtcggtcccaccccttcccgtaccctaacgtacgtaccccg

SEQ ID NO: 142688 - DNA, 668 bp, Homo sapiens
  misc_feature: GYAE6OF02GY5YR.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagaccagggacgcccctaagctacctaactctatgctgcactccgagtttagctaaacggtcgggtcccagttcgaggttcagtggcagtggatcgagggacagtatttcacttcgacaccgtatactagtaatctacgactaacggtagtaagtatttttagacctaaactttaacgttacgttacgttactaaacctaagtaaactttaactaaacgttttacggttttacccgggaaccgttaaacggggtaaccctaaaccgggtaacctttaaaacgtaaaacgtttaaaaccggtaacgtttagggtaccggtacttacgtacctaaccgtactttaccttacggttacctttaccgaacttttcccgtttaaccccggacccctaaggtttcccttaggttaaccc

SEQ ID NO: 142689 - DNA, 701 bp, Homo sapiens
  misc_feature: GYAE6OF02I3QAT.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggactccgaggtgccagatgtgacatcgagctgacccagtctccatcctcctgtctgcaaccggtggagacagtgtcaccgatcacttgccgggcagtcggaacnttgacacctattaaatgtatcaacatagaccaggacggaccccgtaagctcctaatctagttcgctgactactcctaggtttcgacgtaaacggttcggggtaccctagttccggtacggtttacacggtacggtacgaggttaggtacgttaccgttaggggaacgtaacggtacttttaccgaaccgttaccgtaccgtaaaccccgtagtccgtaaggtaactttccgtagtaaccgtaaacgttacggtaaagttactttttacgaaccgttaaaccgtttaactttaccgttaggttacccaaacgttacggtaaactttaacgaacgtttacggttttaaccggaccgtaaacgggtactaaccgtaactaacgtaaaacgttaaacgtaacgttacgtaggtctagaccgtacctataccgtcgtacttaccgacttcccgtcccgtaccagttcctacggtaacc

SEQ ID NO: 142690 - DNA, 911 bp, Homo sapiens
  misc_feature: GYAE6OF02I94MD.46.67.G01.1.454.CMB.1.raw
  modified_base (264)..(264): a, c, t, g, unknown or other
  misc_feature (264)..(264): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtcgcctccatcagttagttggtttcttcgtggggctcgggtccggcagcctcccgaggggacgggctggaatacgagttagggaagtgtctctntagtaggtgggtacgttcctattacctagtcccgtcttctacaaggtacgtcgaacgttccaacctatacttcctgtacggactaccgtccacgtacctaattcttacgttttaccccagtaacgtnttgtagttcgtacggtccggacccgtccggacgtacggaccggtacgggttaccgttttaacgtttacggtggttaacggcggtacgggtacggtaaccggtaacttagtttagttacgggttttagtttttaggggtacggttttaggtttaaccgtttaccggtaaaccgtacccgttaggtaaccggttccgggggacccggggttacccgtaaccccgggtaccccggggttaccggggtacccgggtaaaggggttaaccgttaccgggttacccggggttacccgtttaacccccggttacccgttcccggtttaacccgtacccccgtttaacccccgggtaaaccccggggtaaacccccggttaccccccggtttaaccggggtttcccccccgggtttaaccccccgtttttaccccccccgggtaccgggggttaacccccccctttacccccgtttaaccccccgggtaccccgttaaacccgggggaccccggtttaaccccccggg

SEQ ID NO: 142691 - DNA, 777 bp, Homo sapiens
  misc_feature: GYAE6OF02JXFGZ.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacagtcgagctgaccccagtcctccactccctccttgtctcgaccgaaccggtgggagacgtagtcgtaccaaccatctacctcggccgggacaacggtaccggaactacttacgaacctaacctttaatttaaacgttggtaactacaaactagtaacgaccgaagggacccggtacccctaaggtaccttacctaacttaccttaagtcgtcgtacgtccgtactaccgtaggtttacgacggtaaacgggtcgggtacccaggtcggtaggttcaggtcggcgtaaggtacggtacgtcggtagggaacgtagttacgtttacaccgtacctacctaaccgtactttaacgtaagttaaccgtcgtaaccgaaacgttaacgggtaagttaaacggtttactttaacgtaacgttaaacgttttacttaaccgtaacgttaacgttaaacgtaaaacgttaactttaacgttaaacggtttccgtttaaccgggaaccgtaaacgggtaacgaaaccgtttaacgtaaaccgttaaaagtaaaccggtaagtacggttacgcgtaaggtacccacgttacttcgtacttaccgtacttaccttaccgtccgtacacttagtaccgtacg

SEQ ID NO: 142692 - DNA, 795 bp, Homo sapiens
  misc_feature: GYAE6OF02FUU9B.46.67.G01.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttggacgaccctgtcccctcacctgcgctgtctcgtggtcncctcatcagtgttaggtttctcgtggggctgggtccgnagcctccgaggggagggctaggaactacagttggagtgtctctctataggtggtacggttcctattacgacgttccgtctctacgagtacgtacgagtacacctagtactctcgtggacctacgtccgacgactaacttcttaaccgttttccctaggaactagtaggtacttttcgtacgggttacgccccgggtcccgtcgttacgtaaccgggtaccggggtttacgttttaacgttacgttcggttacgacgggtacggtaacggtaccgggttactttaaggtttatttcgggtttaaggtttttttacggggtaagggtttttcggtttttaaccggttttaccgtaacccgtttaaacccggttaggtaacgggtttcccgggggtaccgggggttccccgtttacccgggtaccccggggttaccggggggtaacccgtaaggggttaaacccgtttaccgggtaccgggtttaccctaaccccgggtttcccgttttacccggtaacccgggttccccccgttaaacccccgg

SEQ ID NO: 142693 - DNA, 809 bp, Homo sapiens
  misc_feature: GYAE6OF02ID0YP.46.67.G01.1.454.CMB.1.raw
  modified_base (97)..(97): a, c, t, g, unknown or other
  misc_feature (97)..(97): n is a, c, g, or t
tcagactagcagtacacgaccggtgctcgatttagagtatacatattgggtttggggagtctcggtcaggacacagcatggacatgagggtccccgntcagctcctggggctcctgctactctggcctccggaggtgccagatgtgacatcgagctcgacccagtcctccactccctcccgtgtctcgaccgaaccggtgggacgacagtcgtaccacactctacgttcggaccgggacgtaacgtacgggaactagttacgaacctaacttttaagtttaaagttcggtactacaaactagtaacggaccgaacggggtacccgtacccctaagtcccttacctaaattcctaggtcgtactacggacctaactccgtttaagttacggaaccgtaaacggggttcccgggtacctaaggttacgggtacggttacgtacggtacggcgtaggtcggtacttcgggtaacggggtataggtttaccttactaccttacgtaaaccacgtagtaccgtaagttacgtacgtacgacgttaacgtaagttaaggtttaactttacggtaactttaacgttttaacttaccgttaacggttaacctaaagttaaacgttaaactttaacgttaacgggttttaccggtttaaccggaaccggtaaaccgggtaacctaaaccgtttaaacgtaaaaccgtttaaaaccgttaaacggtaacggttacggttacgaccgtcgtacccgtaacgttacttcgttaacttccgttacctaccgttacttccccgaataccgtattaccgtaacg

SEQ ID NO: 142694 - DNA, 797 bp, Homo sapiens
  misc_feature: GYAE6OF02HDOWO.46.67.G01.1.454.CMB.1.raw
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtcctctggtcgcctccatcagtagttggtttcttcgtggggctgggtccggctacgcctcccgagggagggctggaatacgnttggaagtcgtctctacgataggtggtacggttcctagttacgacgttccgtctctcgaagtcgtcgacgtacacatatactcgngaactcgtccagtactaacttcgttacgtttcccganaacgtatgtaacttcgtcgtaccgtacccgcgtcgtacggtaccggtaccggtttcgtttttaacttacggttcggtaggtaccggtaaggaccggtacggtaccgtttaaagtttacggttaggtttaggttttagggttggtttacgggtttttaacgttcccggttaacctaacccgttaggaccggttcgggggtaacccgggtcccttacccgggtaccccgggtacgggggtaacccgtacggggtaacttacgggttccggttaccggtacccgtttcccgtaccggttttaacccgccccttcccggtaaaccccgggtaacccgggtaccccctaagggttacccccggtttacccgtttccccccgtaacggtccccgtacccccttttaacccgacccggttaacgcccgtacccccgg

SEQ ID NO: 142695 - DNA, 613 bp, Homo sapiens
  misc_feature: GYAE6OF02GGJT9.46.67.G01.1.454.CMB.1.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (585)..(585): a, c, t, g, unknown or other
  misc_feature (585)..(585): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccgggcaagtcgaacnttgacactattaatgtatcaacatanacgagggaccggcccctaagctcctaatctatgctgcatcctagtttcgacgtaaacgggtcgggtacccagttcggtaggttaccaggtcggcaggtggtatcgtcgggtactagtactttcactctcacctatctagttactctacgacaacggtagaaagttcttttaggaactaacgtttattacgtcgttaaccaaatacgttaaattaacgtagttttaccggtttaccggaaccgtaaagggacctaaccggtaactttaaaccgtaaaacgttaaaacgacgttgggtacgacgttcgtaccgtaaccattactcgtttaccttntaccttcctacccgacctatcctagtac

SEQ ID NO: 142696 - DNA, 909 bp, Homo sapiens
  misc_feature: GYAE6OF02JSR87.46.67.G01.1.454.CMB.1.raw
  modified_base (264)..(264): a, c, t, g, unknown or other
  misc_feature (264)..(264): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggacgaccctgtcccctcaccgtgccgctgtctcgtggtcgccctccatcgagttagtcggtttcttcgtggggctcggggtcccgngtacgccgtacccggaggggacggggtcgtaggtaacgtacgtagttaggtaacgtcggttcctcgtacgaagttaggttacgggtacggtttacccttaacgtttaaccgacggttacccgtccgttccgttaacgtaaacggtacggttaccgtaacggtcccctaaacccttaagttaacctccgttaccgtaccgggtaacccgtaccggtaacccgtaacggtaacctaaaacgtttacccgttaacccggttttttccccgtaacgggtaaaccgtacgttaacggtttaacggttttaccgtaccgggttacccgggaaccccggtcccggtacgtacggtaaacccggttccggggtttaaccgttttaacgtttaccgttacgggttacggtaccggtaaaggtacgggtaacccggttacgttaagtttaacggtttcgggttttaagttttacggggttaacgttggttttaacgtttacccgtaaccgtaaccgttaacggtaccggttacggggtacccggggtccgttacccgggtaacccgggttcggggtaccggtaaagggttaccgtttaacggtcggttaacccgtaccgttacccggttacccgtaccggttacccgtaccccgg

SEQ ID NO: 142697 - DNA, 557 bp, Homo sapiens
  misc_feature: GYAE6OF02FP3IY.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctctaatctatgctgcatccagtttgacaaagtggggtacccatcgaggttcagtggcagtggatcgtgggacagatttcactctcaccgatcagtatctnacgaacgtgaagtatttagactaattacgtttactagtaccaaatagaaactttacaagttgttttaccggaccgaacgggacaaccgtaacttaaacgaaacttaaacgaacttacgtaggtactacggaccaaccattcctagtcttacacttccgttcccacctatctagtaacg

SEQ ID NO: 142698 - DNA, 761 bp, Homo sapiens
  misc_feature: GYAE6OF02H7NC8.46.67.G01.1.454.CMB.1.raw
  modified_base (216)..(216): a, c, t, g, unknown or other
  misc_feature (216)..(216): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (455)..(455): a, c, t, g, unknown or other
  misc_feature (455)..(455): n is a, c, g, or t
tcagactagcagtacacgaccggtgctcgatttagagtatacatattgggtttgggggacctcctgtgcaagaacatgaagcacctgtggtttgcctcctgctggtggcagctcccagatgggtcctgccctggtgcaactgcaggagtccgggcccagactggtgaggtccttcggaacgccctcgtccctcacctgccgctgtcctcgtggtcncctccatccgagttacggttggttttccttacggttggggccttcggggtacccggcacggtccgtacccggaggggacgggggtactagggtaacctacgtagtagggaattcggtactctactagtaggtggtaacggtttcttacgtacgngttaccgtctcgtanaaggtctggactcacgtaagtntctacgtgacacgtaccagtacaagtccgttacgtttcccaggtaacngttacgtcgttctgtccggtaccgtcacgtcgaacgtcggtacgtttactactggtcgagtacggacgtacgtacttaagttcgttacggttttaaggtttcggtaaggtttcgttttacggtaacccttaaccggtcgtaaaacggtcggtaacccgggggtaccggggttaccctcccggggtaacccgggttacggggaacccggttaacggggttaacctaccgggtttccgggtaaccccggttttaccccggtcccggttttaaaccccgtttccccggaaccccctttaacccccgggg

SEQ ID NO: 142699 - DNA, 654 bp, Homo sapiens
  misc_feature: GYAE6OF02IFM5L.46.67.G01.1.454.CMB.1.raw
  modified_base (171)..(171): a, c, t, g, unknown or other
  misc_feature (171)..(171): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttcttcgtgggctgggtcgcagcctccgagggagggctggatacatggagtgtctctcatggtggtaggtctatacncgtccgtctctacagngtcgagtcaccntactctctggacacgtccagcaatcgtacgttttcccagaacgtagtggtactttcgtcggtacgacccgcgtactacggtaccgtaccggggttactttttaacggtttaccgttacgggttcgaccggtaaggtaccggtacgggttactttaaacgttagtttaggttttaacgttttagggttacggtttagggttttactttcgtaaccgtaccgttagtacgtccggggacgggtcctacccggtacccggtacggggcctaagggtactacgttcggtcctacgtcctcgtacgcctaccgacgtacggcctagtcccgtcctacccgtcgcctcccgtaccaccgagacgtacc

SEQ ID NO: 142700 - DNA, 980 bp, Homo sapiens
  misc_feature: GYAE6OF02F7NPO.46.67.G01.1.454.CMB.1.raw
  modified_base (150)..(150): a, c, t, g, unknown or other
  misc_feature (150)..(150): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggngtccgggcccacgactggtgaggtcccttcgggacgacccctgtcccctacaccgtgcgtccttggtcctcgtgggtcnccctccatcctaggttacgttcggtttccttcgggtcgggggtcttcgggggtcccgcgacgtcccgtacccggtaagggggtaaccgggggtctaacggaacttacgtaaggtttagggaacgttgttccttctacgtagtacggtagggtaccggtttaccttacgttacgtacggttccgttcttactacgaaacgtacggttcgaacgtccaacctatttacgtctaccgtgggaaccctaccggtactaacgtacctaactttccgttaaccgttttacccgaagtaaagtactttacgggttaccgtttcggtacggtacccggaccccggtcccgttagggttaaccgggtaaacccgggtttaccggggtttaaactttttaacgttacccgggtttaggtaccggggtaaacgttaccgggggtaaaccggttaaacccgggtttccgttttaaaaggttttagtttaaccggggttttttaacgggttttttttagggggttaaagggtttttaccgggtttttaactttttaaccccggggaaccccctttaaaccgggttaagtacccggggttaccgggggggttacccgggtaccccggtttaaccccgggtaccccggggggtaaaccggggttacccggaaagggtttaaaccccggtttaccggtaccgggtttaaccccggtaaccccgttacccggtttacccgttacccgggtaaccccctaaacccgggg

SEQ ID NO: 142701 - DNA, 973 bp, Homo sapiens
  misc_feature: GYAE6OF02H4PX7.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccgttcggacgccctcgtccctcaccctgccgctgtctcgtggtcgcctccatcgtagtagttggtttcttcgtcggggtcgtcggggtcccggcgacgtccgtaccccggagggggaacggggtcgtaggtaaacgtacgtaagtttagggaaggttcgtaccgttcgtccgtaaagttggggtacgggttaaccggttttaccgttaaactttaaccgacgggttttccccggtcccttacgttacccggtaaaagtacgggtccggtaacgtaccctaccgtaaacttaacgttccgtccggtacggtaacctaacccgggtctaaccggtaactaacgtccgttttaaccggtttttccccgaaggtaaaactacggttaggttaaaccgtttcggtttacgggtaccgttacccccgggcggtttccgtaacgggtcccgggttaaccgggtttccggttttaacttaacgggttccggtttggtaaccggtacggtaaccgggtaaccgggtttaacgttaagtttacggttaaacggtttttggttttaaccggggttgggtttaacgggttttacctttacccgggttaaacccttaacccgggtttaacggaaccgggttaacgggttacccggggtaccggttaccccggaccccggggttaccggggaacccgtttaaccggggaacgttaaccgggttccggtaacccgtccggtaccgtttacccgtacgtccccgtaaccgtaaccggaaccgggtacccgttaccggtcccgttccccgttacccgtcgtaccccggtaccctcccgaaccttaccggactacccgg

SEQ ID NO: 142702 - DNA, 618 bp, Homo sapiens
  misc_feature: GYAE6OF02GMYMO.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtggganacagtgtcacatcacttgccgggcaagtcggaacattgactactatttaaagtggtatcaacatagaccgagggaccgacccctaagctactaatctatgctgcatcctagtttgactaaaggtcgggtacccagtaccgtaggttcaggtcgactagtgatcggaggacagtattcactctacacataccgaagtactcgtagaccgtaagtagtaagttatttagactttaacttattaacttacggtacaaacgtagtaaacttacgtaattccgggtttaacggaaccgtaaacgggtacctaaaccgtaacgttaaactaaaaacgttaaaccgaaacgtttggacggtctacggaacctaactacttccgtattaccgttactacgttcccgttacccgactacgttcctaggtaacc

SEQ ID NO: 142703 - DNA, 761 bp, Homo sapiens
  misc_feature: GYAE6OF02ID2U7.46.67.G01.1.454.CMB.1.raw
  modified_base (304)..(304): a, c, t, g, unknown or other
  misc_feature (304)..(304): n is a, c, g, or t
tcagactagcagtacacgaccggtgctcgatttagagtatacatattgggtttgtcctcctgctggtggcagctcccagatgggtcctgtccctggtgcaactgcaagagtcgggcccacgactggtgaggccttcggagaccctgtccctcacctgcgctgtctctggtcgcctccattttcagtagttggtttcttctgggggggggggtctggggtccggcagccgtcccgaggggaacggggctggaatactagtaggaagtgtctctcagtagtggtaggttcctattacacgtccgtntctacaagagtcgagtcacccattatccttctagggaccacgtccagacaatctacgttttcccagtaactagtgtagttcgtaggtcgaacccgcccgtcgtacggaccgtacgggttacgtttttacttacgttgggtcggtacggtaggaggtaccgggtaccttaagttagttagtttagtttttagggtaggtttagggttttactttaccggtaacctacccgttaaggtacgttacccgggggtaccgggggtcctacccgggtaccccggtcggggggacccgtaaggggtacgtaacggttcgggtcccgtacccggttctacccgttaccgtccccgtacccgtaaccccgtaaccggggtacccctaaccggttcccgggttacccttccccccggttacggtccccttacccccgttcccccgtaccgtaaccggactaccccgg

SEQ ID NO: 142704 - DNA, 610 bp, Homo sapiens
  misc_feature: GYAE6OF02GMVGR.46.67.G01.1.454.CMB.1.raw
  modified_base (601)..(601): a, c, t, g, unknown or other
  misc_feature (601)..(601): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttcggccgggcaaggtcggaactattcgactaccttaatttaaagttggtatacaacatagaccgagggaccggcccctaagctcctaatctatgctgctactcctagtttcgacgtaaaggtcgggtacccagtcgtaggttcaggtcggctagtggtatcggtagggactagtattcacttctcactactcgaagtatctagactaacgtagaagttatttgactaactttattacttacgtactaactataaacttactaagttcgtttaccggaccgtaacgggacctaacgtaacttaaacgtaaaacgttaacgaacgttcgtaggtctacgactaacctagttcctacgttacttacaccttcccttcccgtacctaccgttanacgttaccg

SEQ ID NO: 142705 - DNA, 773 bp, Homo sapiens
  misc_feature: GYAE6OF02HWX48.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtgggctgggtccgcagctccgagggaagggtctaggaactacgtagttggtaagtgtctcgtacgagttaggtggtacggttccttaagttaccgtacggttcccgttctacctacgaaaggtacgttccgagtaccaaccgtattacgttcctcgtacgggaacctaccgtcccgtaagaacctaagttaccgttaacgtttttaccccgaaggtaaacgtaacgtttcgggtaacgttttccggtcggtaaccggtacccggtaccgtacggttacggtaaccggtaccgggggttaactttttaaacgttaccgttcgggttacggaccggtaagggtaacgggtaaccgggttccgtttaaagtttcggttacggttttaggttttacgggtaggttttacgttagtttacccgaccgttaacccgtaggtaccgtacgggtaccggggtcctacccgggtcccgtaggggtacctaaggggtaactcggtacggtaccgtaccgttaccggttaccgttacgccccgtaacccgg

SEQ ID NO: 142706 - DNA, 693 bp, Homo sapiens
  misc_feature: GYAE6OF02JZJCL.46.67.G01.1.454.CMB.1.raw
  modified_base (232)..(232): a, c, t, g, unknown or other
  misc_feature (232)..(232): n is a, c, g, or t
  modified_base (467)..(467): a, c, t, g, unknown or other
  misc_feature (467)..(467): n is a, c, g, or t
tcagactagcagtacacgaccggtgctcgatttagagtatacatattgggtttgggggagtctcggtcaggacacagcatggacatgagggtccccgctcagctcctgggctcctgctactctggctccgaggttgccagatgtgtacatcgagtctagacccagtcctccatccctcccgtgtctgcaaccggtgggagacgaggtgtccaccatcacgttcggcccgggnaacgtcgaactagttgacaccttaatttaagttggtatactaacattacgaaccgtaagggaccgtaccccgtaagtctccctaatctacgttcgacgtagactatccgtagtttcgacgtaaagggtcgggtccctaggtccgaggtttcaggtagtcaggtagtattcgaggaactagtatttcgactactacacctatacgagtaactcagtacgtaagtgaagtactttanaaccgttacttaagttaccgtcttaacgaaacgtaataacttacctaggtttaccgtttaacggtaaccggaaacgtaccgtaaacgtaattaaaccgtaaaagttaaacccgtagtaccgttacgtcgttaaccgtaaccgtaaccctacgtttacggtttccgtaacccgtttaacggtaccttaccgtaacccctcggtttaacttacccgttagttaacccg

SEQ ID NO: 142707 - DNA, 636 bp, Homo sapiens
  misc_feature: GYAE6OF02GOPGL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctcactcctccctgtctgcaaccggtggagacagtgtcaccatcacttcgccgggcaaggtcggaacattacgacaccttatttaaacgttggtatacaacatagaccgaggaccgaccctaagctcctatctatgctgcataccagtttcgaacgtaggtcgggtacccagtcgaggttcagtcggctaggtgtatcgtagggtaactagtactttctaccgttctacctactagtacctaagttaactccgtagtacgaaacgttgtaacgttatttagaccgttaattacttagttacgtacaaactaataacttaacgttaagttacggtttaccggaccgtaaagggtacctaacgtaacgtaaacttaaacgttaaacgtaaccgttagtaccgtcgttacgaccgtaacgtacgttcttaagttcctttaccgtacttcccgttacccgtactctttaccgtgttacg

SEQ ID NO: 142708 - DNA, 633 bp, Homo sapiens
  misc_feature: GYAE6OF02HOXW2.46.67.G01.1.454.CMB.1.raw
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (354)..(354): a, c, t, g, unknown or other
  misc_feature (354)..(354): n is a, c, g, or t
tcagactagcagtacacgaccggtgctcgatttagagtatacatattgggtttgtcctcctgctggtggcagctcccagatgggtcctgtcccctggtgcaactgcaggagtcgggcccacgactggtgaggccttcggagaccctgtccctcacctgcgctgtctctggtgcctccatcagtagtggtttcttctggggctgggtccgcagctcccgaggggaagggctaggaatacgagttggaagtgtctctcatagtggagttcgtatacagtcgtctctanaagngtacgagtacaacctatatctcgtagaccaccgtcagcaagttctacgttttccctaggaactntagtagttctgtcgaaccgtccgcgacgacgtacgggttacgtttacttagtgtacgacgtagacggtagtcttaattagtagttagttttaggtaggtttaggtttattacgtactaccgtagtacgtacgggacgggtccgtaccgcccggtacgggacgtaggtacgtcgtcgtccgtacgtcctactacgtccctaccgaccgaccggaccctacggttcccgtcccgttcccgtaccggtaccctaccctacccgtaccgtaaccgccgtaccg

SEQ ID NO: 142709 - DNA, 670 bp, Homo sapiens
  misc_feature: GYAE6OF02GKFU5.46.67.G01.1.454.CMB.1.raw
  modified_base (206)..(206): a, c, t, g, unknown or other
  misc_feature (206)..(206): n is a, c, g, or t
  modified_base (305)..(305): a, c, t, g, unknown or other
  misc_feature (305)..(305): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcccgtggtgcaactgcaggagtcgggcccacgactggtgaggccttggagaccctgtccctcacctgcgctgtctntgtgcctccatcagtagtggtttctcgtgggctcgggtcgctagcctccgaggggaagggctaggaatacgattggaagtcgtctacgtcaattacggnggtacggttcctattacgaggttcccgtcttcgtcaaagctcgagtccactaattactcgtcacggacaccgttaccagaactaactnttaccgtttcctaaggacttaatggttactcgtggtacaccggtccgtcgtgaaccggtacgggtttccgtttataacgttggtaccagggtacgtacgtagccgtttaaattgttaggtagtttttaccgggagttttggttaccgtttcggaacctaaaccgtttgaacgggtcccggttagggtacccgtaccgggtcccccgttaaggggcctaacggggtaacgttacgtcggtaccgttaaccctctttcccggttatccccctaaccggg

SEQ ID NO: 142710 - DNA, 695 bp, Homo sapiens
  misc_feature: GYAE6OF02FKXGG.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtntcaccatcacttgccgggcaagtcggaacattgactactatttaaattggtatcaacatagaccagggaccgcccctaagcctactaatctatgctgcattcccagtttagacaaagggtcgggttcccagtaccggtaaggtttcaggttcggcgtagtggattcgtgggacctaggtactttaccaacttcctaccgacctacttacgaacgttaattcgtagaccgtaacgtacggtaagtacgttttacgaccttaaacgttatttaacgttacgtaactaacgtaagttaacgtttaactaaagttttcggttttaccggaccgtaaacgggtaaccctaacgtaaccttaaacgtaaaaacgtttaaaccggtaaacgttacggttacgggttacctaacggaccctaaccggtactttacccgttacgtacccttttataaccgtttacccgttacccccggtaacctaccggtttaccttaggtaaccc

SEQ ID NO: 142711 - DNA, 951 bp, Homo sapiens
  misc_feature: GYAE6OF02I4JD9.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagttagttggtttcttcgtcggggtcgttcgggtccggcacggtccgttaccccgaagggggaaacgggggtccttagggaaactacgtaaggtttagggaaacggttcgttacctcgtacgaagttaggttcggtaacggtttccttaagttaacgtacggttccgtcgttactaccgtaaaggtacgttccgaagttacccaaccttaattacttccgttacgtcgggtaacctacccgttaccgagtaacctaaacgttcgttaaccgtttttccccaaggtaaacgtaagttcggttaacgtttccgtacggtacgtcccggtacgtcgtaacggtaccgtacggggttacttttaacttacggtcgtcggaccgaaggtacggtaccgtattaacgtttagtacggtttagttttacggtaggttttcggtttaacgtttccgtaaaccgtaccgttaaggttaccggtacccgggtacgggggtacccgtacccgggttcccccgggtaaggggacccggttaacggggtaaacgttacccggggttacgggtaccccgttaaccgggtttcccccgttaaccgttttaccccggacccgttaacccggttaaccccgggtaaaccggttacccccgttaaccggttttccccggggttttacccccctttaccccccggttacccgggtttaacccccttaccccccccggtttaaccccgtttaaccccggttaaaccccgggtaaggttaaccccccccggg

SEQ ID NO: 142712 - DNA, 626 bp, Homo sapiens
  misc_feature: GYAE6OF02GT2CO.46.67.G01.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (445)..(445): a, c, t, g, unknown or other
  misc_feature (445)..(445): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccactccctccctgtctgccaaccggtgggacgacagtgtcaccatcactggccggnaagtcggaacnttgacactatttaatggtancaanagtacgaccgagggaccgtacccctaagcctacctaatcttagcgtctgcacgtcctagtttgacgtaagggtcgggtacccagtcggaggttcaggtgcgtagtggatcgtgggactagtacttcacgttcaccactatacagtatcgtaggacctaagtgtaagttatttcgaactttaaacgttntttaactgtaacaataacgtaaattacgaattttcggttaccggaacgtaagggtacctaacgtaactaaacgtaaaagttaaaccgaggttcgtagccgttacgaccgtaaccttacgttcgtttacgtacctttacgacccttttcccgtacccgtaccgtactttaccgagtttaccc

SEQ ID NO: 142713 - DNA, 739 bp, Homo sapiens
  misc_feature: GYAE6OF02F8DOO.46.67.G01.1.454.CMB.1.raw
  modified_base (282)..(282): a, c, t, g, unknown or other
  misc_feature (282)..(282): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctcccgaggggagggctaggaatacagttggaagtgtctctcagtagtggaggttcctattacagtccgtntctcaagagtcgagtccacgatatctcgtggacacgtccagacaatctacgttttccctagaagtatgtagttctgtcggaccgccgcgtacgacgtacggggttacttttaacgttacgttgtagtacggaggaacggtacggtacttaatttagttacgttaagtttttcgggtaaggtttaggtttacgttttaccgaaccgtacccgttaggtaccgttccggggtaccgggggtaccttacccgggtaccccgggtcgggggtacccgtaacggggtaaacttacggtttacgggtccctaacccggttccttacccgttaaccgtcccttaccccgaacccggtaaaccgggtaccccgtaacggtttcccccggttacccgtttaccccccggttaccgggtcccctaaacccccggttcccgtaaccccgtaacggtcccgtaccccgg

SEQ ID NO: 142714 - DNA, 660 bp, Homo sapiens
  misc_feature: GYAE6OF02HDV6L.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctcgacccagtcctccatccctcctgtctgacaaccggtgggagacagttgtcaccatctattcggccgganaagtcgaacatgacacttaatttaagttggtactacaacatacgacgagggaccgaccctaagctacctaatctatcgactgactactcgtagtttagacgtaaggtcgggtaccagtcgtacgttcgagtggactaggtcgtatcgtagggactacgtacttacgtactactacacgtatacgtaagttaactcgtacgaacgtaagtacgtaagttacgtttacgaacctttaattaacgttacttaacggtaactaaaacgtaacttaaacgttaacgtaacgtttacgggttaacggtaaccggaaacgggtaacctaacgtaacttaaaaccgttaaaactaaaccggtaagttaccggtagtactactaccgaacctcgttaattacgttactacgtacttcccgacctactagttacccgaataccg

SEQ ID NO: 142715 - DNA, 792 bp, Homo sapiens
  misc_feature: GYAE6OF02JB14X.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcgaggagtcgggcccacgactggtgaggtccttcggacgaccctgtccctcactgcgctgtctcgtggtcgtccctacntaccagttaggttcggttttcttcggtggggtccgtcggggtccgacgacgccgtacccgaggggaacggggtcgtcggaaataccagttagggagttcggtcttcgtcaagtttggtaggtaacggtttaccttagttacgacgttccgtctctacgtaagcgtcgacgtccaactatactcgtacgcgacgaccgtcagactaatcgttacgtttcccaagaagtgtacgtagttcgtcggtaccgacccggtcgtacgtacggtaccggtacgggtttacctttacttaacgttgggttacgacgggtaacggtacgggtacgtacgtttagtttaacgttacgggttttaaggttttttcgggaagggtttttacggtttttacgttaaccccggtaaacgtaccccgttaagggttaacccggtacggggttaccggggtacccgttaccccgggaaccccgggtttaccggggaacccggtaacggttaaaccgttacgggttccgttaacccggttacccggttacccctttaccggttaccccgaccccggttaaaccccgg

SEQ ID NO: 142716 - DNA, 695 bp, Homo sapiens
  misc_feature: GYAE6OF02FW438.46.67.G01.1.454.CMB.1.raw
  modified_base (209)..(209): a, c, t, g, unknown or other
  misc_feature (209)..(209): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
tcagactagcagtacacgaccggtgctcgatttagagtatacatattgggtttgtcctcctgctggtggcagctcccagatgggtcctgtccctggtgcaactgcaggagtcggcccagactggtgaggccttcggagaccctgtccctcacctgcgctgtcctctggtgcctccatcagttagtcggtttctcgtgggctgggtccgnacgctcccgaggggacgggctaggaactacagttcgggaagtcgtcctctacagtagtggacgttcctattacgagttccgtntctcaaggtagtacgagtcaccatatctntcggacacgtaccgagacacgtctacgttttcccagtaacgatcgtacgttcgtacgtcgaccgtccgcgttagaccgtacggggtacgttttaacgttacgtcgttagcgtaaggacggtacggtacgtaagtttacgtagttattttacgggtacgttcgggttaatttccggtaaccgtaacccgttaggacgttaccggggaccgggtccttacccgggaccccggttgggggtacccgaacggggtaactacggttcggtacgtaacccggttctaccgttccgtccttacccgacgtaaaccgggtccctaacgtcccggttccttccccgtcggaccctaacccgtcccgtaccctagccgtacccg

SEQ ID NO: 142717 - DNA, 744 bp, Homo sapiens
  misc_feature: GYAE6OF02HG081.46.67.G01.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (735)..(735): a, c, t, g, unknown or other
  misc_feature (735)..(735): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgctaaccggtgggatacagtgtacacatcacgttgccgganaaggtcgaacnttcgactaccttatttaagtgtatcaanatagaccgaggaccgacccctaagctacgtaatctatgctagctactcccgtagtttacgacgtaaacgggttcgggtaccctagtacggtacggttaccgtaggtacggcgtaaggtacggtaagtccgggtaggggaaacttaacggttattttaccaacgttcttaccaaccgtaacttaccgtaagttaactccgtaacgaccgttaaacggtcgttaaaggttacttttacggaacctttaacgttttaacttaaccgttacgttaaacctaaacgtaaacgttaacgtttaaccgtagttttacggttaaccggtaaccggtaaagggtaacctaaccggtaaaccttaaaacgttaaaaacgtaaaccggttaaccgtagggttacgtacccttaacggaccttaaacctcgttacgttaccggttacctttacggtaccttaacccggttcccacgttaccttaccgttntaaacccgg

SEQ ID NO: 142718 - DNA, 707 bp, Homo sapiens
  misc_feature: GYAE6OF02I1AVC.46.67.G01.1.454.CMB.1.raw
  modified_base (182)..(182): a, c, t, g, unknown or other
  misc_feature (182)..(182): n is a, c, g, or t
  modified_base (256)..(256): a, c, t, g, unknown or other
  misc_feature (256)..(256): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgtactggtgaggccttcgganaccctgtccctcacctgccgctgtcctcgtggtcgcctaccatcagtagtcgtttctcgtggggctgggtccgnagcctaccgagggacgggctaggaatacgagttggaagtgtctctcagtaggtggtaggttcctagttacacgtaccgtcgctnaagtgtacgatccgaactatactctacgtaggaccgaccgtaccagactaaactacttacgttttacccagtaaagtctaggtacttcgtgtaccgaccgtcgacgtagtaaccgcgggttcctttaagtccgttggcgtacggacggaggtaccggtactagttagttaggtttacggtttttagggtagtttaccgggttttaacgttccgtaaaccgtacccgttaagggacccgggtttaccgggaccgggggttcccgtaccccggggtaacccgggttcccgggacgggtaaaccggttaggttaacccgtcgggttacctcccggggtttaccctcccggttacggcccccttaacccgg

SEQ ID NO: 142719 - DNA, 686 bp, Homo sapiens
  misc_feature: GYAE6OF02ICOH0.46.67.G01.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgcaccatctacgttgcccggganaacggtcggaactattcgactaccttaatttaaattcggtatacaacgtactagaccgacgggaccgacccctaagcctacgttaacacttaatcggactcgctaatcctaggtttcgaccgtaaggtcgggtacccagtcgtagtcgaggtgcgaggtgtactcggtaggtactagtactttacgactacctacgacctagtcgtaagtaactcgtcgactaacggtagtaagttacgttacgaacgttaactttacgttacgttagtacctaaagtaacgttaatttaacgtacgttacggtttaccggaaaccgggtaggtacctaacggtaaccttaaacttaaaagttaaaccggaacgtttacggacggtaccttacggacctaacgtaccgtttaccgtcgtttaaccgttaacctcgttaccccgttaccgaccttaacgttaccgtagttaaccg

SEQ ID NO: 142720 - DNA, 692 bp, Homo sapiens
  misc_feature: GYAE6OF02JI78D.46.67.G01.1.454.CMB.1.raw
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (292)..(292): a, c, t, g, unknown or other
  misc_feature (292)..(292): n is a, c, g, or t
  modified_base (390)..(390): a, c, t, g, unknown or other
  misc_feature (390)..(390): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttgggggaccctcctgtgcaagaacatgaagcacctgtggtttgtcctcctgctggtggcagctcccagatgggtcctgtccctggtgcaactgcaggagtccgggcccacgactggtgaggccttcggagaccctgtccctcacctgcgctgtctctggtncctccatcagtagttgtttctcgngggctgggtccgcagcctccgagggagggcgtggaatacattaggagtgtcgtcncagtagtggaggttcctattacagtccgtctctacaagtagtcgagtacacctatctctgtcggacaccgtccgagactaactcgtacgttttacccngtaacgatagtgttactgtacgaccgccgtcgtacgacgtacgggttacgttttacgttacgttgtcgtacggacgtacggaaccgtnttaagttacgttagtttacggttttgggtaggttttacggtttacgtttccgtaacctacccggttaacggtacgtttacccggggtaccggggtaccggtacccggtaccccgggttacggggtacccggtaacgggtacgttaacccggtttccgggttacccgttaccccggtttaccctacccggtttaccggtaccccgttaaccccgg

SEQ ID NO: 142721 - DNA, 687 bp, Homo sapiens
  misc_feature: GYAE6OF02IKYV4.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagacccctgtccctcacctgcgctgtctctggtgcctccatcagtagtggtttcttcgtgggctgggtccggnagccgtcccgaaggggacgggctgggaatacgagttggaagtcgtctctacgattaggtgggtagtttcctaattacgacggtcctcgtactgaaaggcgttcgagtccaaccattactctcgtacggacaccgtccagccaatcgtacgttttcccagaacgtagtgtacgttcgtaggtcgacccgtccgtacgtgtaccgtacggtcttttaataccgtgtcggcgaggacgtacgacgttagttatgtttagttttagggacgtttgttaacttcgtacctaccgtaggacgttcgggacgggtccgttaccgtacccggtcggggaccggtaaggtacgttacggttccggtaccaccggttccgttccgttaccgcccgttacccgaccggtaacccggtccctacggttcccggttaccccttaccccgccggtacccgtaccctcccgtacccgtaccgaccgtacccg

SEQ ID NO: 142722 - DNA, 757 bp, Homo sapiens
  misc_feature: GYAE6OF02JCP0H.46.67.G01.1.454.CMB.1.raw
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (396)..(396): a, c, t, g, unknown or other
  misc_feature (396)..(396): n is a, c, g, or t
tcagactagcagtacacgaccggtgctcgatttagagtatacatattggggtttgggggacctcctgtgcaagaacatgaagcacctgtggtttcgtcctcctgctggtggcagctcccagatgggtcctgtccctggtgcaactgcaggagtcgggcccagactgggtgaggccttcgggagacccctgtcccctnacctgcgctgtctctggtncctccatcagtagttgtttcttcgtggggctgggtccggnacgcctcccgaggggaaggggctgggaatacagttggaagtgtcgtctacagttaggtgggtacggttccctatttaaccgngttacccgtntccttacaagtacggtcgaagtccacctatactcgtcgtcggtaaccnccgtacctagactaacttaccgttacgtttttacccgaggtaacgtactaggtacgtttcgtaggtaccggtaccgtaccggcgtagaccggtaacggggttacgttttaaacttaccggttgttacggacggtaacggtaccgacggggtactttagtttaacgttggtttaagttttttagggaggttttcggtttaacgtttccggtaaccgtacccgttaagggtaaccgttccggggtaccgggggtccttacccgggtaccccgggtcggggtaacccggtaggggtaaccttacggtaccggttaccggttaccccggttacctttacccggttaccgtaccccgtaaccccgg

SEQ ID NO: 142723 - DNA, 822 bp, Homo sapiens
  misc_feature: GYAE6OF02GI41Z.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtgttgtttctcgtgggctgggtccgcagccgtaccgagggacgggctaggaatacgagttggaagtcgtctcgtacagtacggtgggtacggtttccttagttaccgaggttcccgtctactacgaagtacgtacgtacgtaccaccgtaattacttcgtccgttagggaacctaccggtaccaacgactaaacttaccgtttacgtttttccccgaaggtaaacgtacgtttcgtacgtttcgtacgttaccggaccccggtccgtccgttacgggaaccggtaaccgggggtttacctttttaaacggtttaccgttgggttcggtaccggtaaacgggtacgggtaaccggttactttaagtttacggtttaggttttagtttttttagggggtaggtttttacgggttttaacgttttacccgtaaacccgttaaccgtttagggtaaccggttccgggggtaccggggtaccccgttacccgggtacccccggggttacggggaaccggtaaccggggtaacttacccgggttacggttcccctaaacccgggttcccgtttaaccccgtttaccggtaccccgttaacccccgg

SEQ ID NO: 142724 - DNA, 624 bp, Homo sapiens
  misc_feature: GYAE6OF02F9VZ0.46.67.G01.1.454.CMB.1.raw
  modified_base (413)..(413): a, c, t, g, unknown or other
  misc_feature (413)..(413): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtcctctggtcgcctccatcagtagtggtttcttcgtgggctgggtccggcagcctccgagggagggctaggaatacagttggagtcgtctctcatgtggacggttcctattacgagtccgtctctacaagagtcgagtcaccattactctcgtgacacgtcagcaaactctacgttttcccagaacgtataggtagtttctggttcgacccgtccgtcgtacgacgtacggttcttttaagttacgtgtgnggaagaggacgtactagttatgttagttttggagtttgtttacttacgacgtacctgtacgtcgggaccggtcgtaccggcccgtggggtaccgaacggtactacggtccggtactaccgttcctaccgttcgccctaccgaccgaaccggtccacggttcccgtacccttccccgtcgccctaccccgttccacccgtacgaccctaccg

SEQ ID NO: 142725 - DNA, 728 bp, Homo sapiens
  misc_feature: GYAE6OF02IVLQ3.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctcgacccagtcctccatccctcctgtctgaccgaccggtgggacgacagttcgtccacctagtccacgttcggcccgggacaaggtccggaactgttacgaacctacctttaatttaaacgttgtatacaactaagtaacgaccggaacgggaccgtaaccccgtaagacccttacctaactactatacgtctagtactacgttaccgtagtttaccgagtaacggtcgggtaccagttggtacggtcggtcgacgtaggtagtacgtcggaggtactagttacgttacaccgtccacgtacctagtctaagtacgttactacgtaactaacgtagtacgttacgttagtaccttaactttaagtacttacgtaaactaacggtaattaacgttaacgttacgtttaccggttacgtaaccggtaaacggtaacctaaccgttaacgtaaaccgttaaaccgttaaaccgttaagttaccgggttaacgtaccgtaccgtactaactaacggtaccttaagtccttaccgttacccgttccctaccgtacctacggtttacgtctaacgttacc

SEQ ID NO: 142726 - DNA, 872 bp, Homo sapiens
  misc_feature: GYAE6OF02F7SO9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccactccctccctgtctcgccaaccggtgggagacagtcgtcaaccatccgtacttccggccgggcaaggtacgaacgtattcgaacctaaccttaattttaaagttcggtatcaaacgattaacgaaccgtaacggggaccggtacccccttaaacggacccttaccgttaaaactctaacttacggtccttacggtaccaacgtttaccgtaacgtttacggtaaccgtaaaacggggttcgggggttacccctaagttaccgggtttaccggggttacttacgggcggtacgaacggtagggttacgtacggtacggggaacgttacggttactttaccgaccttaccgttacgaccctaacgttaccgtaacgtaacttacgttacgaacgttaacggtacgtaacgttaggttttaacttaacgttaacgtttaacgtttaccgttaacgttaacctaaaccgtaaggtttaaactttaaccgttaacgttttaacgggttttacccggaaaccggtaacgggtaacccgttaacggtaaccctttaaagttaaaaacccgttaaaggttaaaacccggttaggttaacccgttacggttaacctaaccgtaacccttaacgtacccgttacgtttaacccgttacttaccccgtttcccgtttacccccgtacttaccggttacccgttatttaaacccgg

SEQ ID NO: 142727 - DNA, 820 bp, Homo sapiens
  misc_feature: GYAE6OF02J25QM.46.67.G01.1.454.CMB.1.raw
  modified_base (575)..(575): a, c, t, g, unknown or other
  misc_feature (575)..(575): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtcgcaactgcagggacgtccgggcccagacgtgggtcgacgggtcccttcgggacgtaccccttgtcccctacgcccgtggccgtccttgtccttcgttgggtcaccctcattccgaggttcgttggtttcctcggtggggcttagggtcccgctacggccgtaccggaaggggtaacgggtcgtacggtaacttacgtagttacggagttcgtaccgtctacgtagtaggttcggtacggttaccttacgttaccgacggttccgtctccgtaacgtaaggtacggtacgtcgttaccaaccgtattaccgtctcggtacgaccgtaccgtaccgacgtacttaacgttccgtttaacgtttcccgtaaggtaacgtgttacggttacttcgtcgtaccggcccgtacgccgttacggaacgttcgggttaaccgtttntaacggtcggtacggtacggtaacggtaccgtgttacgttaacgtttggtttacgtttacgggttttacggtacgttttccggtttacgttaacccgtaaccggtaaacccgtagggttaaccggttcccggggtaccggggttccgtaccccgggtaaccgggttcccgggaacggtacggttaacgtcggttaccccgtccgtaccccgtttcggtacccgtttaccggaccccgtaacccgg

SEQ ID NO: 142728 - DNA, 730 bp, Homo sapiens
  misc_feature: GYAE6OF02ICUNV.46.67.G01.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (284)..(284): a, c, t, g, unknown or other
  misc_feature (284)..(284): n is a, c, g, or t
tcagactagcagtacacgaccggtgctcgatttagagtatacatattggggtttgggggagtctcggtcaggacacagcatggacatgagggtccccgctcagctcctggggctcctgctactctggctcgagtgccagatgtgacatcgagctgacccagtctccatcctccctgtctgcaaccggtgggacacagttggtacacctatcctacgttcggacccgggtntaacggtcggaaacncgtttgaacctacttatttaaatcggttactacaactanacgacccgagggacggtaccccctaggcctacctaatactagtgtcgtgctatccgtagtttcgacgtaacggttcgggtacccagtacgtagttacgaggttaggaccgagtaggtacgttaccgtagggaacgttacggtacttttaccgtaactccttactacccgtattaacctaacggtttactacggttacacggtaacgttaggtaacgttacttttacggacctttaatttacgttaccgtattaacctaataagttaaacgtttactaaggttttacgttaacggaccggtaaacgacttaacccggtaacttaaacccgttaaaaaggttacccaacgttttaccgggtaattcccggaatcccgtaaccgttagttacccgttatttaccgtaaccttcgggtacccttacccggtactacgtaccgatttaccg

SEQ ID NO: 142729 - DNA, 692 bp, Homo sapiens
  misc_feature: GYAE6OF02GAORE.46.67.G01.1.454.CMB.1.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggnaagtcganatgacactattaatggtatcaacatagaccgaggaccggacccctaagctacctaatctatgctgcattcctagtttcgacgtaaaggtcgggtaccccagtcggtaaggtttcaggtcggacgaggtcggactcgtagggaactaggtactttacaactcctaccgaccctataccgtaagtaacttcgtacgacctaaacggttagtaaagtacgttttacgaacttaactttaacgtttaaccgttacgttaactaaactaaacgttaattaaccgttaaacgtttcggttttaaccgggaccgtaaacgggtaacctaaccggtaaccttaaaccgaaaaactttaaaaccgaaacgttcgggttacggtaccgttaacgtaccgtaacctaacgttaccgttacgtttccttaaccgtactttcccgttaccccgtaacctaccgttaccgtagttaacccg

SEQ ID NO: 142730 - DNA, 769 bp, Homo sapiens
  misc_feature: GYAE6OF02HNVXF.46.67.G01.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctntggtncctccatcagtagtggtttctgtgggctgggtccgnagctccgagggagggctggatacattggaagtgtctctcgagtagtggtacggttccttaattacgtacggtccgttctaccgtacgaagacgttcgacgtcaacccgtatacttccgtacgtggaacctaccgtccgagtacctaaattccgttaacgttttcccctaaggaaacgttatacggttagtttccgtcggttacggaccccggtaccgcggttacggaaccgtaccggggttcgttttacttacgttgggtcgtacggtaagacggtaccggtacttaagtttacgttagtttagttttagggtacggtttaggtttacgtttacgtaccttaccgtacgtacgtacgggtaacgggtccgtaccggtacccggtcgggaccgtaacgggtaacgttaccgtacggtaccgtacccggttccgtaccgttaccgaccctaccgtaacccggtaaccgggtacccgtaaccggttcccggttacccccgtttaccccggttccgtaccccgtacccccgttacccggtaacccgtaacggtcccgtaaccccgg

SEQ ID NO: 142731 - DNA, 794 bp, Homo sapiens
  misc_feature: GYAE6OF02I0H0E.46.67.G01.1.454.CMB.1.raw
  modified_base (739)..(739): a, c, t, g, unknown or other
  misc_feature (739)..(739): n is a, c, g, or t
tcagactagcagtacacgaccggtgctcgatttagagtatacatattgggtttggggagtctcggtcaggacacagcatggacatgagggtccccgctcagctccgtggggcctcctgctactcgtggcctccggaggtcgccagatgtgacatcgagctacgacccagtcctccacttccctccctggtcctcggaccaaccggtgggaacgtactaggtctaccaaccgtattccacgttcggaccgggacaaggttccggaaacacgtttcgaacctaaccgttttaattaaaacgttcggtaactacaaacgtactaacggaaccggtaacggggaccgtacccgtaacgtacctaccttaagttcctaggtcgtccgtgtacctacgttaccgtaggttcgaaccggtaaacgggtccgggtaccttataccggggttacgttaccgaagggtcggtaaccgtagggttacggaacggttccgggtacggaaacggtacgttttaacgttaccgacctttacccggtacccttaaaccggtaacgtttacgttaacggttaaccggtcgtttaaccgacggtaaacggttagttaccgttaagttccgtaacgttaactttaggtacttacgtaacgtaacgtaagttacttaaacgtacggtttacgtaccggtaaccgtaaggacttaaaccgaacgttaaactaaacgtaaactaagtacgtgtacgtacnccggtaacttccgacgttctacgttactaccgtccttcggctacgtactcgtacg

SEQ ID NO: 142732 - DNA, 876 bp, Homo sapiens
  misc_feature: GYAE6OF02JUOGS.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagtatgtgacatcgagctagacccagtctaccatccctccctgtctgacgaaccggtgggancgagtcgtccaacctagtccacttcggccgggataaacggtaccggtaacattcggaaacctaccttaatttaaagttacggttactacctaacgtaactaagtaaccgacggggtaacccggtaccccgtaaaggtaccttaccttaaaacgttcccttaagttccggtacgtaacggtactaacctaccggttaacgttttacggaaccggttaaaagggttccggggtaacccgtacgttaccggtaaggttaccggtaagggttcggaccggtaacggtagggtaacttccgggtacggggtaacttaacgggtaacctttacggtaccttacccgtacctaacccgtattaaccgtagtttaaaccgtccgttacggtaacgtaaggttaaaccggttaaaggttacgttttaccggaaaccgtttaaccgttttataaaccgttacggttaaaccgttaaaacgaaacgtttaaacgttaacttaaaccgggttttaaccggtttaaccgggtacccgtaaaccgggaaccgttaaacgaaaaccctttaaaacgtaaaacgttaaacccggtaaagttaggtaacgtaccgtaacgacctaacggtaccgtacgttaacttccgtaactacccggttacccctactacccgtaattcccggtaattaacg

SEQ ID NO: 142733 - DNA, 796 bp, Homo sapiens
  misc_feature: GYAE6OF02GX271.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggagtgccagatgtgacatcgagctcgacccagtctccatccctcctgtctcgaccgtaccggtgggacgacgtagtcgtaccacctattccgtaccgttcgggcccgggacctaaacggtaccgggaaactagtttaccgaaccttaaccgtttaaattttaaacggttggttacttacctaaactaacgttaacggaacccggaaggggacccggtaaccccgtaacggtccttaccccgtaaattacctaacgttcggtaccgttacggacctaccgttaccgttagggtttacggtaccgttaaaacggggttccggggtacccctaaggttaccgggttacggttacgtaacgggtacggtacgtagggtaggttacgtcggtacgggtaacgtacgttactttctaccgtactacacctatacgtatacgtacttacgacgtaacgtagtaacttagtttactacttacttactttactacgtaacctaacgtaagttataaaccgtttagttacgtttaccggtaaccgtaacgggtaactaaccgttaacttaaaccgtaaacgttaaaccgtaacgttggtagtaccgtactaccgaacctacgttaccgtacttccgttactacgttcccgttcccttacgtacttccgtagtaccg

SEQ ID NO: 142734 - DNA, 873 bp, Homo sapiens
  misc_feature: GYAE6OF02GCGNI.46.67.G01.1.454.CMB.1.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgganaagtcgaacnttgactactattaatgtatacaacatagaccaagggaccgaccctaagctaccgtaattctaatcgtctacgacctaacgttcccgtaggtttacgaaccggtaaaacgggttccgggggtaacccctaacgttaccgggtaacgggtttaccgtaagggttacggggtaccgtaaggggttacggtaacgtttaccgggtaacgggggtaaacccgttaaggtttaaccgtttttacctaacccgtttacccgtttaaccctaaaacccgtttaaacgttaaccgttaaaccggtttaaacttacccgttacggtaaacccggttaaaccggttaagggtaaaacgtttttaacgttttaacgtaaaccgtttaaaacccgtttttaagtttaaaccgttaacgtaaccgttaaaaaccgtaagtttaaaaccgtttaaacgtttaaacggttttaccgggttttaacccggaaaccgggttaaaccggggaaccttaaaccggtaaacctttaaacgttaaaaacgttaaaacccggtaacgttacgggtacgttactacggtaaccttaacccgtagttaccttacggttaacctttacgtaaccgttccccgttacccgtacgtacttaccgtagttaaccc

SEQ ID NO: 142735 - DNA, 862 bp, Homo sapiens
  misc_feature: GYAE6OF02IMYIA.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccggtgganacagtgtcacatcacgttgccgggataacgtacggaacagttgaccacctaatttaaagttggtatacaacactagaccagggacgcccctaagctactaatctaatcgtctacgacgtactccgtagtttcgacaaaggtcgggtacccagtacgtacgggttacaggtcggacgaggttacggtaacgttcggtacgggtaactacggtacgtttaccaacgttacccgtcgaaacccgttacgttaacgtaacgttaaactttccgtttaaacggaaccccgtaaacgggttaaacgtaaacggtttacctttttacggaaccgtttaaaaccttttaacgtttaaccgttaacggtaaacctaaactaacggttaaaacttttaaccggttaaaggttttccggttttaaccggggaaacccgtttaaaacgggggtaaaccccgttaaagggttaaaaccccgtttaaaaacggttaaaaaaccgttttaaaaaacccgggttaaaccgttacgggggttaacccgggttacgttaacgttaaccccgtaaaccggtttaaccttaacccggtttaacggttttaccctttaaaccgtttacccggtttaccccgttttaccccggaacccgtttaacggtttaccccgtttaaggttaaaccccgg

SEQ ID NO: 142736 - DNA, 617 bp, Homo sapiens
  misc_feature: GYAE6OF02HQSZY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattcgacacttatttaaatggtatacaatatagaccgagggaccgacccctaagctactaatctatgctgctactcctagtttcgacgtaaggtcgggtacccagttcgaaggttcaggtcggctaggtggatcggtagggactaggtactttacacgttcctacgacctatacgagttaactcgtagacgtaacgtagtaacgttatttcgacttaaacgtttattacgttcgtaacaacgtagtaaacttagtaacgtttcgttacggacgtaacggactaacgtaactaaacgtaaaacttaaaccgagttacgtacggtactacgacctacctacttcgtacgttaccttcttacttcccgtacccgtactacgttctacgttaac

SEQ ID NO: 142737 - DNA, 742 bp, Homo sapiens
  misc_feature: GYAE6OF02IP91N.46.67.G01.1.454.CMB.1.raw
  modified_base (201)..(201): a, c, t, g, unknown or other
  misc_feature (201)..(201): n is a, c, g, or t
  modified_base (414)..(414): a, c, t, g, unknown or other
  misc_feature (414)..(414): n is a, c, g, or t
  modified_base (736)..(736): a, c, t, g, unknown or other
  misc_feature (736)..(736): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctcgaccctagtcctccatccctcccgtgtctgaccaaccgggtgganagcgtgtccacactctaccgttggccgggtacaaggttaccggaacacgtttacgaacctaaccgtttaaaattttaaagttggtactacaaacgatacgaaccgacggggaccgtaacccaacgtaccgttacctaacgttacttagtcgtcgtacgactactccgttacgtttgacgtaacgggttcgggtacctacgcgttaggttaccnggtacgacggtaggtgtaacggttggcgggtaactaggttactttacgtaactccttccgactacctaacgtaagtaactcgtaccgaacggtacgttacgttaaagttacgtttaactaccttaatttacgtttaagttacgtaactaaactacgtacgttatacgtacgtttcggttaccggaacgggtaacggtaacctaacgtaacgttaaaagttaaaacgttaaaccgtacggtaccgggttacgtacgaccgtaaccgtaccttaagttccttaacgttcttaccttcccttacccttacccgttacctacgttntaaccg

SEQ ID NO: 142738 - DNA, 628 bp, Homo sapiens
  misc_feature: GYAE6OF02I3FJ4.46.67.G01.1.454.CMB.1.raw
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaaggtcggaacattgactacctaatttaaattgtatcaacatagaccgagggacggcccctaagctcctaatctatgctgcatccagtttgcaaggtgggtcccagtcgtaggttcagtggnagtggatcnggganagtattcactctcaccntcataatctagacaacggtgaattcgttttagactaacttattacttacgtactaactaagttaaacttacgtaactttaggtttttaccgggaaccgtaaacggggtaccgtaacgtaaccttaaacctaaaaacgtttaaaccgtaaagttacggttacgggaccgttaggacccgtaacctaacgttccgttagttaccctttacgtacctttacccttaccccggttacctaccgtttccttagttaacccg

SEQ ID NO: 142739 - DNA, 574 bp, Homo sapiens
  misc_feature: GYAE6OF02IRRFI.46.67.G01.1.454.CMB.1.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (411)..(411): a, c, t, g, unknown or other
  misc_feature (411)..(411): n is a, c, g, or t
  modified_base (506)..(506): a, c, t, g, unknown or other
  misc_feature (506)..(506): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtggggctgggtccgcagcctccgaggggagggctaggaatacagttggaagtgtctctcataggtggtaggttcctattacagtccgtctctcgaagagtcgagtcacatactctcgnggacacgtccagcatctacgttttccagtaagntgtagttctgtcgaccgccgcgtcgacgtacggttcgtttattacgtggtcgacgagacggtacgnttattagtgttagttttggagtttgttattccgaactacctgacgtcggacgggcctcgcccggtggacgaggtactgtgtcctacgtctcgtcnccgtaccacggacggccctacggtcccgtaccttccccgcggtccctaccctccgactacgcctaccg

SEQ ID NO: 142740 - DNA, 675 bp, Homo sapiens
  misc_feature: GYAE6OF02FS8SL.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacgttggccgggacaaggtcggaactattgactaaccttaattttaaacgttggtatacaacatacgaccgagggaccggcccctaagctacctatctatgctgcactcctagtttcgacgtaaaggtcggggtaccctagtcggtacgttcaggtcggcgtaggtggtactcgtagggactagtacgtttctacttctacgacctatacgtaagttaactcgtcgtaactaacggtagtaaagttagttttcgaacgttaaactttattaaccgttagtaactaaacgtaattaaacgtttactaaacgttttcggttttaaccgggaccgtaaagggtaccaaacgttaacttaaaccgtaaaagttaaaccgtaacgttaggttacgtacgtacggtaccaacttacttccgttattaccttacgttaccttcccgtttacccgacctttacgtacgttcgtaacg

SEQ ID NO: 142741 - DNA, 833 bp, Homo sapiens
  misc_feature: GYAE6OF02IFIOD.46.67.G01.1.454.CMB.1.raw
  modified_base (165)..(165): a, c, t, g, unknown or other
  misc_feature (165)..(165): n is a, c, g, or t
  modified_base (180)..(180): a, c, t, g, unknown or other
  misc_feature (180)..(180): n is a, c, g, or t
  modified_base (223)..(223): a, c, t, g, unknown or other
  misc_feature (223)..(223): n is a, c, g, or t
tcagactagcagtacacgaccggtgctcgatttagagtatacatattgggtttggggagtctcggtcaggacacagcatggacatgagggtccccgctcagctccgtggggctcctgctactctggctcggaggtgccagatgtgacatcgagctgacccagtcnccatcctcctgtacngccaacggtggactacagtgaccaccatcacttcggccggganaacggtcggaaacctagttcgaacctactttaattttaaagtggttaactacgaaccataacggtaccgacggggaccgaccccgtaaggtccttaccgtaaactcttaaacgtcgtcttggacctacgtaccgtagtttacgagtaaacggttcgggtaccctaaggttccggtacgggtttacgtacggtacgggtaccgaggttacggtaacgtccggtagggtacccgttaagtaacgttttccgaaccttacgttcccgaaccacgtaccgtaagttaaacctccggtttaggaccctaaaggtcggtaaaagttttacgttttattaaaaccgttttgttaacccgtaagtttaaaccccgaaattaacggttaacctaaagtttaagttaccccgggtttttaaggaaccccgtaaacggggaactttaaccggtaaaccgtaaaacgtttaaaaccgttaacgggtaaacttcggggtttaactaaccggtacggtaacggttcccttaaacggtttcccttacggtttccccggtttaacttaaccggttacccccgtttaccgtacccgttaacggttcttaccgttaacgttaacccgg

SEQ ID NO: 142742 - DNA, 577 bp, Homo sapiens
  misc_feature: GYAE6OF02GT6W9.46.67.G01.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacntgacactattaatgtatcanatanacaggcgaccctaagctactatctatnctncactccagttgacgaaaggtcgggtacctagtcgtaggttcagtggctagtgatcgaggtacagtatttcactctacacctatctaagtatacgtgactaacggtgtaaagtatttagacttaacttacttatcgttaacaactattaattaactaagttcgtttacggaaccgtaacggaaccgaacgtaacgttaaactaaacgttaaacgaacgttacgtagttacgtacgaactacctaacttcgttcgttaccttactaccgttccctaccgtacctacgttactacgtaac

SEQ ID NO: 142743 - DNA, 724 bp, Homo sapiens
  misc_feature: GYAE6OF02F0VSX.46.67.G01.1.454.CMB.1.raw
  modified_base (256)..(256): a, c, t, g, unknown or other
  misc_feature (256)..(256): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctcccgaggggaacgggctggaatacgagttggaagtgtctctanagtaggtggagttcctattacgacgtccgtctctcaagtagtcgagtccacatactctcgtgacaccgtcagcaatctacgttttccagagatgtagttctgtcgaccgcgcgtaggacgtacgggttcgttacttacgttgtacgagacggtacggtacggtacgttaagtttagttacggtttagttttagggttaaggtttcggttttacgtttaccggaacccttaccgttaggtacgttacccggggtaccgggtaccgtacccggtacccggtacggggacccgtaacggggtaaccgttacgtccggttaaccgtacccgttaccgttacccgttaccgtacccgttacccgacccgggtaacccggttacccgtaccggtttcccggttccccgttaccccccggtccggtaccccttaccccccgtccggttaaccccgtaaccggtaccgtacccccg

SEQ ID NO: 142744 - DNA, 941 bp, Homo sapiens
  misc_feature: GYAE6OF02J0OAD.46.67.G01.1.454.CMB.1.raw
  modified_base (262)..(262): a, c, t, g, unknown or other
  misc_feature (262)..(262): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttcttgtgggcttgggtccgcagcctccgagggaacggctggaactcgagttggaatgtctcgtacagtagtggngttcctagttaccagttcctcgtcgtcaaagtcgtacgacgtctaaccgacgttacttccgtctaggacctaccggtccgaagaccaagttaccgttacgtttttaccccgagtaaacgttacgtcggttaacgttcgtcggttacggtacccggtcccggtacgttacggtaaccggtaccggggtttaccgtttttaacgttacccggttcgggttaccgtacccggggtaaggtaccgggtaaacccgggttacgttttaaaggtttacgttacggttttaaacgggtttttacgggttaagggttttaaccgggttttttaacgttaccggttaacccgttaaaccccgtttacgggtaaccgggttttacccggggaaccggggggtttaccccgtttaacccgggtaaccccgggtttacccgggggaaacccggttttaacgggggtaaacccgtttaacccgggtttaccggttaccggttaaccccggtttaccgtttacccgttacccggttaccccgttacccggttaacccgggtaaaccccgggttaccccgttaaaccgtttccccgggtttacccccggtttaacccccggttcccggttaacccgttaaaccccccggttccccgttaaaccccggggttaacgacccgtttaaccccccggg

SEQ ID NO: 142745 - DNA, 660 bp, Homo sapiens
  misc_feature: GYAE6OF02F95GR.46.67.G01.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (244)..(244): a, c, t, g, unknown or other
  misc_feature (244)..(244): n is a, c, g, or t
  modified_base (286)..(286): a, c, t, g, unknown or other
  misc_feature (286)..(286): n is a, c, g, or t
  modified_base (602)..(602): a, c, t, g, unknown or other
  misc_feature (602)..(602): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgcacgtgganacagtgtcacntcactgccggacagtcgactatgactactattaatgtatcaacntacgacgacgggaccgaccctaagcctacctaatctaatacnacactcctagttcgacgaaggtcgggtaccctagtcgtacggttcgaacgtggacgtaggtcgacgttcgtacggggtaacgtacgttagtttacctaccgttacttcccaaacgttagtaccgtaaagtacttacgtaccggtaacgtaaaccgttagggtaaacgtttaagttttacgaacgtttaaaccttaagtttaccttaagttacctaaacgttaaagttaaacttacgttaagtttcggtttaaccggaacgaacggtaccgaaacgttaactaaactaaagttaaacgacgttgtacgatcctaacnccgttaatccgttagtcccttacgtattcccgttacccactttgcgttaagcttacgg

SEQ ID NO: 142746 - DNA, 901 bp, Homo sapiens
  misc_feature: GYAE6OF02HEU3G.46.67.G01.1.454.CMB.1.raw
  modified_base (135)..(135): a, c, t, g, unknown or other
  misc_feature (135)..(135): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtnccagatgtgacatcgaactgacccagtcctccatccctccctgtctgcaaccggtgggacgacgagtcgtccaacctagtctacgttcggcccgggtacaaacggtccggaaactagttacgtaaaaacccttatttaaaacgttgggttaactaccgaaactaactaacggaacccgaacgggggtacccggacccccttaagtcccttacccgttaaattcccgttaatcggtcctaggtaccctaacgttaccccgtaaggttttccggaacgtaaaaccggggttcccgggggtaacccctaagttacccgggtaagggtttaccgtaaggggttcgggtaacccgtaggttaacgggtaacgttccggtaggggaaaccttagggttaacttttacgaaccgtttcccgtaacgtaaaccctagtaccgtaacgtttaactccgtacgtaccgtaaacggtaggtaaacgttagttttaccgaacttaaaccgttaacgttaaccgtacgttaacccgtaaacgtaaggttaaacctttaaccggtaaacgtttccggttttaaaccgggacgttaaaccggaaccgttaaccgtaaaccgttaaaccgttaaaaagttaaacccggtaaacgttacggtaaccggttacgtaccgtaccgtaacccgttaacgttcccggttaccgtttacgttaacccgttacgttacccgtttcccgtaaccgttaaccttcggtaaccgttaccttaaccggtacgg

SEQ ID NO: 142747 - DNA, 703 bp, Homo sapiens
  misc_feature: GYAE6OF02J0EVV.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcccttcggagaccctgtccctcacctgcgctgtctcgtggtcncctcatcagtgtggtttctcgtgggctcgggtccgcagcctaccgagggaacgggctaggaatacgagttagggtaagtgtctcgtactagtaggtggtacggttcctagttacgtacgtccgtctctacgagacgtcgactccactattactctcgtcgactcgtacagtactaagttcctactttccagtaacgtagtacgttacgttcgtggtcgacccgtccgtacgtacgacgtacgggttacttttacgtacgtcgttcgaggtacggtacgtacggtacttacggtttagttaggttacgtttttagggtacgttttacggttttacgtttaccgtaaccgttacccggttagtaccggtaccggggtaccggggtcccttacccgggtacccggtacgggtaacccggtagggttaaccttacgggttaccggttacccgtaccggttaccctttacccgttaccggtccccgtaacccgg

SEQ ID NO: 142748 - DNA, 805 bp, Homo sapiens
  misc_feature: GYAE6OF02H8HIX.46.67.G01.1.454.CMB.1.raw
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (778)..(778): a, c, t, g, unknown or other
  misc_feature (778)..(778): n is a, c, g, or t
tcagactagcagtacacgaccggtgctcgatttagagtatacatattgggtttggggagtctcggtcaggacacagcatggacatggagggtccccgctcagctccgtggggctcctgctactctggctcgaggtgccagatgtgacatcgagctcgacccagttcctccactccctcctgtctgacaaccgtggganacngtcgtcacatctacgtcgccggganaacggtacggaactattacgacctaactttaattttaaagtcggttaatacaaactagtaacgaaccggacggaccgtaccctaagcctaactaatcgttatgctgacataccgtagttcgaacgtaacgggtcgggtaccctaggtacggtaggtttacgaacgggttcggaacacgggttacggtaaagttccggttaggggaaccgttaaggtttacctttaccaaccgtttaaccgccctaaccgtaaaaacttcgttaaaacgttaacctgttaccgaaacggttaaaccggtaattaacggttacttttacaaccttaactttttaaacgtactacggtaacaaacgttaagttaaaattaccgtaagtttacggtttaccggaaaccggtaacggtaaactaacgttaaacctaaaaacgtttaaaacgaaaaccggtttagaccggtttaaggaccgtttaaccggaccgttaaaaaccctgtttacccgtttaaccggttacttttacccgggtaaccccttcgggttaaacccccccggttntttaaccccggttcgttaacctaaccg

SEQ ID NO: 142749 - DNA, 587 bp, Homo sapiens
  misc_feature: GYAE6OF02F4A1N.46.67.G01.1.454.CMB.1.raw
  modified_base (195)..(195): a, c, t, g, unknown or other
  misc_feature (195)..(195): n is a, c, g, or t
  modified_base (358)..(358): a, c, t, g, unknown or other
  misc_feature (358)..(358): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttgggggagtctcggtcaggacacagcatggacatgagggtccccgctcagctcctggggctcctgctactcgtggctccgaggtgccagatgtgacatcgagctgacccagtatccatcctccctgtctgcaaccggtggganacagtgcaccatcacttggccgggacaagtcggaacattgacaccttaatttaatggtatcaacatagaccagggaccggcccctaagctacctaatctatgctgcatccagttgacgaaggtcgggtacccagtcgtaggttcaggtgcagtgatcgtgganagtattacgactcgacactatacagtaatctagactaagtgaattntttacgacttaacttattactgtacaactagtaattactattcgtttacgacgtaaggtaccaacgtaacttaactaaaacgttaaacgtaacgttagtacggtactacggacctaaccgtattccgttacgttacttacgtaccgtttcccttaccccggtacctacgttacctagttaacg

SEQ ID NO: 142750 - DNA, 761 bp, Homo sapiens
  misc_feature: GYAE6OF02H2FQA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagcgtcgaccagtcctccatccctcctgtctcgcgaaccggtgggagacagtgtaccacatcacgttcggaccgggactaaggtacgggaaactagttacgaacctaacgttaattttaaaagttggtaactacgaaacacgtaagaaccggacgggtaccgacccgtaagccttactaactactacgtacgcgtacgacctaactaccgttaggtttacggaacgtaaggggttaccgggtaacctgttacgggttacggtaacgtggttacgccgtagggttacgacgttcggttacgggaactaggtacctttagaccgttcctaccgtactaatcccggtaaatagtccgtaagaccgtaggtaacgtaacgtttgttaacgaccgtttaaatttactaaccgttacggtaacaaacgttaaacgttaaacttacgttttaaacgggtttcgttaaaccgggtaaaccgtaacgggtaaacctaaccgggtaaacttaaaaacgttaaaaccggttaaagaaacggttacgttacgacggttaacctcgtaaaccttctacgtttcggtacttccttacgtacccttactcgtaacttcggattaacc

SEQ ID NO: 142751 - DNA, 844 bp, Homo sapiens
  misc_feature: GYAE6OF02I0332.46.67.G01.1.454.CMB.1.raw
  modified_base (224)..(224): a, c, t, g, unknown or other
  misc_feature (224)..(224): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtggagacagtgtaccaccatctacttggcccggganaacggtacggaactagttcgacctacttaatttaagttggtaactacaaacagtaacgaccgaagggtaccggacccctaagtacctacgtaactctaattcggacttgacctacgtcctaaggttttacgaacgtaaaagggttccggggaccctaggtacgtaagggttctaagggtcggtacgtaaggtggaacgttcggtacgggtactaaggttactttaccgtacttacctacgtaaccctagtacgtaaacgttaacgtccgtacggtaacgtaaacggttagtaaacggtttacttttaacggaaccctttaacgttttaaacgtttaccgttaacgtaaccgtaaaacgttaaccggttaaaacttttaaacggtaaacgttttttaccgggtttaaccggggaaaccgttaaaccgggtaaaccgttaaccgggtaaaaacccttttaaaacggttaaaaaccgttttaaaaaccggtaccggttttaagggtaccggttacgttaaccggtaacccttaaaccggttacgtttaccggttactttaccggtttaacttaccctttaccggtttacccccgacgtttaaaccgttccttagttaaacccg

SEQ ID NO: 142752 - DNA, 798 bp, Homo sapiens
  misc_feature: GYAE6OF02IVNZH.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtctgcaaccgtggganacagtgtcaccatcacttggccggctaaggtcggaacagttacgactaaccttaatttaaattggtatacgaactataacgaaccgagggaccgtcccctaagctacctaatcttaactgtactgacctacgtacccttagtttacgaacggtaaaaggtccgggggttacccaaagttccgggtacggggttttaccaagggttcggtaccgtaaggggttccgtaaggttccggttaaggggggtaacccaaggttaacgttttacctaccgttacccttaccaaaccctacgttaaccgtaacggtttaaacttccgtaacgtaaaccccgtaaaggtaaccggttaaagtttaacttttacggtaaacctttaaacttttaacgttaaccgtttaggttaaacctaaacggtaaaacgttaaacgttaacttaaacggttttcgttttacccggggaaacgtaaaccgggtaaaccaaccgtaaccgttaaattaaaaccgttaaaacggtaacgttacggtcgtacgttacacggtaacctattcgttaacgttcctttagtaccttccgttaccctaaccgtacttacccgtataacg

SEQ ID NO: 142753 - DNA, 708 bp, Homo sapiens
  misc_feature: GYAE6OF02FRURK.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatccctccctgtctgccaaccgtggganacagtgtcaccatcacttgccgggcaagtcggaacattgacctacctaatttaaattggtatcaacatacgaccgagggaccggcccctaagcctacctaatctatgctgctactcctagttgacgtaaacgggtcgggtaccctagtcggtacggttacgaggtcggacgtaaggtggtacgttacggtaggggaactaggttactttaccgaacctttcctacccaacctacgttactaaggttaacttcgtacgtaacgaaacgttaggtaaatttacgttttacgaacctttaacgttactttaaccgtagtaacctaaacgtagtaactttacggactttaacggtttcggtttacccggacgtaaacggggtaacctaaccgttaaaccgtaaaaccttaaaacgttaaaccgtaacgttggtacggtactacgtacccaacttacgttcttaccgtttccgttaaccttacctttcccgttacccctacgttaccgttattaaccg

SEQ ID NO: 142754 - DNA, 867 bp, Homo sapiens
  misc_feature: GYAE6OF02HDVSE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggagacagtgtacaccatctacgttggcccgggacaacggtaccggaaactagttacgaacctaaccttaatttttaaaagttgggttaacttaccgtaaactaacgttaacgaaccggaacgggggtaacccggtacccccgttaaacggacccgttaacccttaaacgttaccttaagttcggaccttacgtactaacgttcccgttaaggtttaggaaccggtaaagggttcccgggggttaccctaacggttaccgggttagggtttaccggagggttacggacgttaagggtggtaacgttcggaacggggtactaacggttaactttccgtaaccgttccgtaccgtaaaccgtacgttacgtaaagttaacgttaccgtacgtaacgtaaccggtaaggttaaacgttaacgtttttacgaacgtttaaactttaacgtttaccgttaacgttaacctaaaacgttaagtttaaaactttaaaccgtttaacgtttcgggttttacccgggaaacggtaaccgggtaaaccgtaaccgttaaccttaaaacgtttaaaacgttaaaacgtaacgttaaggtacgtacgtaccgtaaccgtaccgttacgttccgttaacgtttcccttacgttacccttcccgttacccgtacctacgttaccgttacttacg

SEQ ID NO: 142755 - DNA, 862 bp, Homo sapiens
  misc_feature: GYAE6OF02F70IS.46.67.G01.1.454.CMB.1.raw
tcagactagcagtacacgaccggtgctcgatttagagtatacatattgggttggggacctcctgtgcaagaacatgaagcacctgtggtttgtcctcctgctggtggcagctcccagatggtcctgtccctggtgcaacgtgcaggagtccgggccacggactggtagacggccttcggagaccctcgtccctctaccgtgcgctgtccgtctcggtcgcctccatccgagttacggttcggttttcttaccggtggggtcttcgggggtacccgtacgacgtccgtacccggaagggggacgggtaccgtaggaacgtacgtacgttaggaagttcgtcttactccagtacggttggtacggttaccttagttacgcgttaccgtcgtctacggtaacgtacgtacggtacttaccgactaagttactacgtcgtacgaacctaccgtccgtaagactaacgttccgttaccgttttcccgaaggactgttaggtactttcggtacggtccggacccgttccgtacgtaccggtacggttaacccgggtttgttttaacgtaccgttcgggtacgtaacggtaagggtaaccggtacgttaacgtttacgttaacgttggtttaaccgggtttttaggggtcggtttttaaccggttttaaactttccccgggtaaaaccgtaaccccgttttaggggtaaccccgttaccgggggaccgggttacccggtaaccccggggtttcccgggttaaccgggggtaaaccggggtaaccgtttaacggttaacccggtaccgggtttaccggtaaccccggtttacccggtttacccggttaccctaccccgggttaacccccg

SEQ ID NO: 142756 - DNA, 574 bp, Homo sapiens
  misc_feature: GYAE6OF02G8T2V.46.67.G01.1.454.CMB.1.raw
  modified_base (444)..(444): a, c, t, g, unknown or other
  misc_feature (444)..(444): n is a, c, g, or t
  modified_base (571)..(571): a, c, t, g, unknown or other
  misc_feature (571)..(571): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtctccatcctccctgtctgcaaccggtgggagacagtgtccaccatcacttggccgggcaaggtcggaacattgacaccttatttaaattggtatcaacatagaccgaggggaccgcccctaagcctacctaattctatgctgcatcctagtttcgataaggtggggtcccagtcggtaggttacgagtggctaggtggatcgtagggactagtatttcactctactacatctagtaatcgtgtacgaacgtgaagttatttacgactaactttattactntacaactataaattactaagttcgtttacggaccgtaacggactacgaacttaaacgtaaacttaaacgaacgttagacgactacgacctaactattcgtactcttctactccttcccactactgtntac

SEQ ID NO: 142757 - DNA, 900 bp, Homo sapiens
  misc_feature: GYAE6OF02GMJVW.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctcgtggtncctccatcagtgtggtttctcgtgggctgggtccgcagcctccgaggggagggctaggaatacagttaggaagtcgtctctacagtaggtggtaggttcctagttacgacgttccgttctcctacgaaggtacggttcgagtaccaacctattactctacgtacggacctacgtacacgacctaactccgttacgttttcccgtaaggtaacgtagttacggtagtttccgtacgtaccggtaacccggtccgtacgtacggtaaccgtaccgggggttactttttaacgttaaccgttgggtacgtaccggggtaacggaacggtaccgggtacgtttaacttttacggttaggttttaggtttttagggttaaggggtttcggttttaaccggtttaccgtaaacccggttaaccccgttaaaggttaccgggttaccggggggtaccggggtacccgttaccccggggtaaccccgggttccggggggtaacccggtaaacggggtaaaccggttttaccgggttaacccgggttaaccccgttacccggttcccgtttaacccgttaccggtaccccgttaccccggtaaaccgggtaaccccggggtaaccccgttacccggtttccccgggtttaccccccttttacccccgggcccggttaaccccgttcccccccgttaacccggtaaccccggtaccggtaaccccggttaaccccccgg

SEQ ID NO: 142758 - DNA, 924 bp, Homo sapiens
  misc_feature: GYAE6OF02IA6YS.46.67.G01.1.454.CMB.1.raw
  modified_base (269)..(269): a, c, t, g, unknown or other
  misc_feature (269)..(269): n is a, c, g, or t
tcagactagcagtacacgaccggtgctcgatttagagtatacatattgggtttgtcctcctgctggtggcagctcccagatgggtcctgtccctggtgcaactgcgaggagtcgggcccacgactgggtgaggcctttcgggataccctgtccctcaccgtgcgctgtctctggtgcctcatctagtagtggtttctcgtgggtcttgggtccggcagtcctaccggaggggtaacggggtctaggaatacgtagttggaattgtcctntctagtaggtggtacggtttcctattacgacggttccgtactcctacgaacgtagtccggaagttccgaaccctaattacgttaccgttcgtaacggtacctaccggttacctaacggacctaaacttaccgttacggttttttaccccgaaggttaaacggtacgttaacggttacgtttacgttacggtaccggtacccggtcccgttacgtacggtaacccgggttaccggggttacgtttttaaacgttttaaccggttgggttaacgggtaccggttaacggtaacgggtaccgggttaactttaaacgtttaagtttaccggttttaaaggtttttagggtacgggttttacgggtttttaacgtttaaccggtaacccttaacccggtaacggttaccggttaaccgggggtaaccgggggtttacccgtacccgggtaaaccccgggtcgggggtaaccccgtaacggggttaaaccgttaccggttaccgggttaccgtaacccggtttccgttaaccggttaccgtaccccgttacccgtaacccggtaaccgggtcccttaacgggttccccggttacccgtttcccccggacgggttacccctaacccccgttaccggaacccgttacggtacccgtacccgg

SEQ ID NO: 142759 - DNA, 750 bp, Homo sapiens
  misc_feature: GYAE6OF02F0VI0.46.67.G01.1.454.CMB.1.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
  modified_base (400)..(400): a, c, t, g, unknown or other
  misc_feature (400)..(400): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctaggtgcaaactgcaggaggtccgggacccacgtactggtgaggtccttcggacgaccctggtccctnacctgcgcttgtctctggtacncctcattcagttcgttggtttcctcgtggggtacgtggggaccgtcagccgttcccggaaggggacgggtctaggatacgtagttggaagtcgtcttcgtctagtagtggtacgtttcctagttaccgnggttacctcgtctacaaaggtagttccgagttccaaccgagtttaccnccgttacgtacggacctaccggtccgaagtactaaacgttccttacgttttaccctaagggaaagtgttacggtgtttacgtcgtacggacccggcctaggtcgtaacgggccgggtttacgtttacgttacttcggtacgcggtaagtccggtaacggttactttagttattggttttaagtttttcgggaacgtttttagggtttaccttacggtacccgtacctagggaaccgtttgggaccggggtccctacccgggtaacccggtgggggtaaaccgaccgggtaagtttcccggtacggttaacccctcggttttacccctacccgttcggtccccctaaccgg

SEQ ID NO: 142760 - DNA, 723 bp, Homo sapiens
  misc_feature: GYAE6OF02HIG89.46.67.G01.1.454.CMB.1.raw
  modified_base (172)..(172): a, c, t, g, unknown or other
  misc_feature (172)..(172): n is a, c, g, or t
  modified_base (209)..(209): a, c, t, g, unknown or other
  misc_feature (209)..(209): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtagtgtttcttcgtgggctgggtccgnagcctccgagggagggctggaatcgagttggatgtctctcgagtagtggacgttcctattacagtccgtctctacaagtgtcgagtcacatactctactggactacgcagcaatctacgtttccngaatatacgngttctggtacgacccgccgtcgtacggtacgtacgggttacttttattacgtcggtcgacgtacgtacggtacgtactttaagttattacgttagttttaggtaggtttaggtttacgttaccgaacttaaccccgtaggtaaccggtttcgggacccggggtccgttcccggaacccgggttcggggaacccgtaaggggttaacgtaccggtttaccggtaccgtacccgttcccgttaccgtttaccccgtaccctacccggtaaccccggtaaccgggcccccgttaaccggtcccggtttaccccgtttcccccccggtggtaccccccttaaccccgttaccccgttaccccggtaacggtacccgtacccgg

SEQ ID NO: 142761 - DNA, 722 bp, Homo sapiens
  misc_feature: GYAE6OF02FWSH2.46.67.G01.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
tcagactagcagtacacgaccggtgctcgatttagagtatacatattgggtttgtcctcctgctggtggcagctcccagatgggtcctgtcctggtgcaactgcaggagtcgggcccacgactggtgaggccttcggagaccctgtccctcacctgcgctgtctctggtcncctcatcagtagtggtttctcgtgggctgggtccgnagcctccgaggggagggctggaactacagttggaagttgtactcgtacagttaggtggacggtttcctaagttactacggtccgtcttctacgaagtagtcgagtcacatatctcgtaggacaccgtcacgactaactccgtacgtttttcccagaacgtatgtacgttcgtgtaccgaccgccgtctcggaacgtaccgggtcttttagttaccgtgttacggacggaggaacggtaccgtacgttaatttagttagtttacgttttacggtacggtttaggtttaaccgtttcggaaccttaacccgtaggtacgtaccggggaccggggtccttacccgggacccggttcggggaccgtaacgggttaacgtaccggttcggtacccgtaccgttccgttacccgttacgtcccgttaccgaacccggtaccggacccgttaaccggtcccggttcccgttcccccggtaggacccctccccgttaccgtacccgtaacggccgtaaccccg

SEQ ID NO: 142762 - DNA, 638 bp, Homo sapiens
  misc_feature: GYAE6OF02HT685.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgccgggcaagtcggaacattgactacctatttaaattggtatcaacatagaccgagggaccgcccctaagctcctaatcgtatcgctgctatccagtttagcgtaaaggtcggggtacccagtcggtaggttcaggtggcagtaggactcgtcgggacagtactttcaacgtctacaccgatacgtaacgttaatcgtcgtaacgtaacggttagtaagtagttttacggaccttaaacttattaaccgtagttacgtaaacgtaagtaaacttactaaacgttcggttttaccggaccgtaaagggtaacctacggtaaaccttaaactaaaacgttaaacgaacgttagtacggtctaggaccctaactactacgttcttaccgttactacgtttacccttcccgtaccgtacttacctacggttac

SEQ ID NO: 142763 - DNA, 792 bp, Homo sapiens
  misc_feature: GYAE6OF02HZUMY.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtcgcctccatcagtagtggttttcttcgtggggcgtggggtccggcgacgccgtacccgaggggaaggggcgtaggtaagtacgtagttgggaagtggtctctactagtgtgggtacgttaccttattacgacggtccgttctctacgaagtacgtacgacgtaccaacctatactccgtcgtcggaacctaccgtaccgaagtacctaaacgttccgttacgttttcccgtaaggtaaagtacgttaggttaacgtttcgtacgtacggtaccccggccgtacgtacgaccggttaaccgggttcgttttaaacttaccggttggttacggtacggtaaggtacggtaaccggttactttaacgttttaagttacggtttttaaggttttttagggtaagggtttttcggttttaaccgttccgtaacccgtaacccgttaagggtaccggttacggggaccggggggttccccttacccgggtaccccgggttacggggaaccgttaacggggttaaccttaccgggttaccggtaccgtacccgtttaccgtaccggtttaccgtaccccgtaccccgg

SEQ ID NO: 142764 - DNA, 763 bp, Homo sapiens
  misc_feature: GYAE6OF02GN8K7.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggacgaccctgtcccctcacctgcgctcgtctcgtggtcgcctccatccgagtagtggttttctcgtggggtctgggtccggcacgcctccgagggaggggctggaactacagttaggaagtgtctcgtcgagtaggtggtacggttcctaagttaccgacgttccgtctctacgtaagtgtacgagttccaaccgtattactcgttacgtcggtaactaccggttacctaggactaaacgttctaacgttttcccaaggaagtagttgtacgttcgtgtacggaccgtcgcgttaggaacctacgggtacttttacgtacgttggtacgacggtagagggtacgtacgttacttagttacgttaggtttttaggacggttttaggttttaaccgttaccgtacccgttaaacccgttaacgggtaccggttaacccggggtacggggggttacccctttacccggggaaccccgggttacggggggtaaccccggtaacgggttaacccgttaccgggttacgggttaaccccgttacccgggtttaccccttcccgggtttaccgacccccgttaacccccggg

SEQ ID NO: 142765 - DNA, 548 bp, Homo sapiens
  misc_feature: GYAE6OF02GZS6W.46.67.G01.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (528)..(528): a, c, t, g, unknown or other
  misc_feature (528)..(528): n is a, c, g, or t
  modified_base (541)..(541): a, c, t, g, unknown or other
  misc_feature (541)..(541): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcggagaccctgtccctcacctgcgctgtctctggtgcctcgatcagtagtggttcttcgngggctgggtccgnagctccgaggggagggctaggaatacagttggaagtgtactctacataggtggagggttcctaattacagttccgtctctcaaggtagtcgagtcaccatacgtctntggaaccacgtcagcaaatctagttttcccagaagtntgagttctgtgaccgccgctgacacggggtctttaacttcgtgtgtacgagacgacgtctagttatgtagttttggagttggttattcgactacctagacgtgacgggtcacgcccgtgggcaggactacgtgtacncgtntactgcctcacgacggccatccgtccgtccctgccnccctactccacgngtacccg

SEQ ID NO: 142766 - DNA, 669 bp, Homo sapiens
  misc_feature: GYAE6OF02G1KM7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgacaaccggtgggagactagtcgtcaccatctacgttcggcccgggactaacggtacggaactagttcgaacctaaccttaattttaaaacgttggtaacttacaaactatacgaccgaggggaccggcccctaagctcctaatctatgctgctatcctagtttgacgtaaggtcgggtaccctagtcggtaggtcaggtggacgtaggtggtacgttcggtagggtactaagttacttcgtactcgtaccaacctatactagtactctagaccgtaagtagtaagttatttacacttaaatttacgtacttcgtaacaacgttaataacgtttactaagtttacggttaccggaaccgtaagggtaaccaaccggtaaccttaaacgtaaaacttaacggtaaaccttgggtgtaccgtacgtacctacttaacgttcttacgttaccttcgttaccttccccgttacaacgttcttactagttaaccg

SEQ ID NO: 142767 - DNA, 728 bp, Homo sapiens
  misc_feature: GYAE6OF02FQSZI.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagagtcgagtcacatatctactgacacgtccagacaatctacgttttcccgagaacgtatcggaacgtttcgtggttaccgaccgggtccctacgttacggaaccgtaccgggggttcctttttaagttaccgttcggtggaccggtacggtacggtaacggtacttaacgtttacgttagtttaaggttttttagggaaggtttgggtttaacttttaccggaacctaaccccgttaggtaacgttacgggtaccgggggtccttacccggaaccccggttcgggggacccgtaacgggtaactaccggttacgggtaccacccggttccttaccgttaccgtccccttaccgaacccgtaaccgggtaccccttacggtcccggttcccgttacccccgtcggtacccctaaccccgttccctaccgaacggtaccgtaccccg

SEQ ID NO: 142768 - DNA, 558 bp, Homo sapiens
  misc_feature: GYAE6OF02FWZJ3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggaccggcccctaagctacctaatctatcgctgcatcctagtttcgacaaaggtcgggttcccagtccgagttcgagtggcaggtgatcgtgggacagtattcactctcaccatcagtaatctagcaacgtagaatagtttcactaacttattacgtgtacaactagtaacttacgtaattcggtttacgaccgtaggacctaacgtactaagtaaactaaacgactagtagctagacctactacttcctgttacctttacgtacttcctacccggacctacgttactagtaacc

SEQ ID NO: 142769 - DNA, 692 bp, Homo sapiens
  misc_feature: GYAE6OF02JSYQ3.46.67.G01.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctgacccagtctccatcctccctgtctgcaaccggtgganacagtgtccaccagtcacttggccggnaaggtcgaactattgacctactatttaaactgtatcaacatagaccgaggaccggaccccaagtcctacgtatactatcgctcgacatcccgtagtttacacgtaaaggtcgggtaccctagtaccggtaggtttaccacggttgacgtaggtacggtattccggtagggtaactacggttactttaccgaaccttcgttaccaaccgacttacgtaagtacttacgtcgaacgtaacgtagtaacgttatttcgacgttaaacttacgttacttacgtaactaacgtaataacgtttaacctagtttacggttttaccggaacgtaacggtaaccgtaacgtaacgtttaaactaaacgtttaaaaccgtaacgttacgtacggtaccgttagtaacccgaactttacggttaccttcgttaacccgtttataaccgtttccctcccgttaacctacgttcgttacttaaccg

SEQ ID NO: 142770 - DNA, 613 bp, Homo sapiens
  misc_feature: GYAE6OF02IDSYY.46.67.G01.1.454.CMB.1.raw
  modified_base (248)..(248): a, c, t, g, unknown or other
  misc_feature (248)..(248): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtggggctgggtccgcagctccgagggagggctggaatacagttggaagtgtctcncagtaggtggtaggttcctattacagtccgtctctacaagatcgagtcaccatatctctggacacgtcagcaatctagttttacccngaatatgtagttctgtacgacccgcgtctaggacgtacggtctttatacgtgtgcgagagacggcttagttatgttagtttggagttgtttattcgactaccgttagcgtcggacgggcctacggtcccgtaggggccaaggggtaattcgtacggtacctaccggtcctaccgttacgacccgtacccgaaccggtaaccgggaccctacggttcccggttcccctttaccccggacggtaccctacccccgttacccgtacaacggcctaccccgg

SEQ ID NO: 142771 - DNA, 717 bp, Homo sapiens
  misc_feature: GYAE6OF02GVMCJ.46.67.G01.1.454.CMB.1.raw
  modified_base (357)..(357): a, c, t, g, unknown or other
  misc_feature (357)..(357): n is a, c, g, or t
  modified_base (463)..(463): a, c, t, g, unknown or other
  misc_feature (463)..(463): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcgagtagttcggtttcttcgtgggctgggtccggcagcctccgagggagggctaggaatacagttggaagtgtctctctagtaggtggtagttccgtattaacgacgttccgtctctacaagtagtcgagtcaaccatactctcgtagaccacgtccagactatctacgttttccagaanctgtagttcgtgtcgaccgtccgcgtacggacgtacgggttcgtttacttaccgtgtggacgtacgacggacgtacgttaattagttacgtttagtttttacgggnggttttaacggtttacgtttaccggtacccttaaccgttaaggcgtccggggtaccgggtacctcccggtacccggtacggggtaccggaacgggttaaacgtaccggttaccgtaccgttaccgtcccgttaccgtttaccgccccgttaacccgaccgggtaaacccggcccgttaccggtacccggtttccccgttcccccgtaccggtccccttaaccccgtccccgtaacgaccggtaccgtaccccgg

SEQ ID NO: 142772 - DNA, 810 bp, Homo sapiens
  misc_feature: GYAE6OF02FT0PJ.46.67.G01.1.454.CMB.1.raw
  modified_base (146)..(146): a, c, t, g, unknown or other
  misc_feature (146)..(146): n is a, c, g, or t
tcagactagcagtacacgaccggtgctcgatttagagtatacatattgggtttggggagtctcgggtcaggacacgagcatggacatgagggtccccgctcagctccgtggggctcctgctactctggctcggaggtgccagatgngacatcgagctgaccctagtcctctactcctccgtgtctcgacgaccggtggagacgtgtcgtcaccgtatccgtacgtcggaccggactacggtaccggaactgttcgaacctaccgttaagtttaagtgtaactacaaactgtaacgaccggacgggtacccgtaccctaagtccttactaactcgttagtcgtccgtagacgtacttaccgttaggtacggaacggtaaacggggttccggtaacccttaaggtccggttaacgggttacgagggtaggaactacggggtacgtacgtacgggtagggtaactaggtttacccgttacctaaccggttccaacccgtaccgtacgtttaacgtaacgttaacctaccgttacgaaaccgttagggtaaagtttaccgtttaacgtttaccgaaaccgtttttaacgttaacgtttccggtaaaccgtaaacttaaccgttaaaagttaactttaaccggtttaagggtttcccgggttaaacggaaccgtaacgggtaaaccgaaccgttaaacctttaaagtaaaaccgttacgtacgtacggttcgaccttacggaccttaacggttagttacccgttacttacgttaaccgtccgtttacccgcgttaacctcttacgtaatacccgg

SEQ ID NO: 142773 - DNA, 702 bp, Homo sapiens
  misc_feature: GYAE6OF02GHAVK.46.67.G01.1.454.CMB.1.raw
  modified_base (348)..(348): a, c, t, g, unknown or other
  misc_feature (348)..(348): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgacaaccggtgggagacagtcgtcaaccatccacgttggccgggactaaaggtccgggaaactagtttacgaacctaaccttaaattttaaaacgttggttaactaccaaacaagttaacgaacccgaaggggaccgacccccttaaagccttaaccttaagtccttaancgtaccttgactacttcctaggtttacgactaaagggtcgggtacccagttcggaggttcagtcggctaggtgatcgtaggactagtacttcacttcacacctatactagtaactctagaacgtacgtagtaagttatttacgacgttaacttatacgttacgtactaaacgtaacgttaaattaacgtaacgtttacggtttaccggaaccgttaacgggtaacctaaccgttaacgttaaacgtaaaaacttaaacggtaaaccttagggtacgtacctaggaaccctaaccgttactacgttaccgttacttacgtacttacccgttccctactacttacgtaacgttacc

SEQ ID NO: 142774 - DNA, 789 bp, Homo sapiens
  misc_feature: GYAE6OF02IZDPT.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtgcctccatcagtagtggtttcttcgtggggctcgggtccgcagcctccgagggaagggctggaatacagttggaagtgtctctcataggtggtacgtttcctaatttacgacgttcccgtacttcgtacgaaagtagtccgagtccaacctattactccttcgtacgggaacctacgtaccagacctaacttccgttacgtttttacccctaggaaacgtacttggttacggtttccgttaggtaccgtaaccccgggtcccgtacgtacggtaaccggtaccggggtttaccgtttttaagttacgtagggttacgtaacgggtacggtaacgggtaccggtactttaacgttttacgttaggttttaaggtttttttacggggaggttttacgggtttttacgtttaccgggttaaaccctacccggttaagtaccggttccgggggtacccggggttcccgttacccggggtaacccccgggtacgggggtaaccgtaacggggtaaccgttacggttaccgggttaccggtaccccggttcgtttacccgttaccggtccccgttaacccccgg

SEQ ID NO: 142775 - DNA, 852 bp, Homo sapiens
  misc_feature: GYAE6OF02IY1RM.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctcgtggtgcctccatcagtagtgtttcttgtgggtctgggtccgcacgtcctccgaggggaacgggctaggaatactattacgggaagttcgttctctctagttaggtgggtacggtttaccttagttaacgtacggttccctctaccgtacgaagtaggtacgtacgtaccaactaattacgtctccgtacgggaacctaccggtacctacggacttaaccgttcgttaccggttttcccaaggtaacgtacgttacggttagttccgttacgtaccggacccgtcccgtcgtacggaaccggttacggggtttacttttaacggttacggttaggtaccggtacggtacggaacggtaacggtccgtttaaagttttaaggttacgttttaagggtttttacggtagggttttaccggtttaaacgtttaccgaaccttaacccgttacggttaacggtccggggtacccgggtccgttacccggaacccggttacggggaccgtaaggggttaaccgtcgttaccggttccgtaccccgtttcgtacccgttaacccgtcccggtaaccccgtaacccggtcccggggttaaccccgtaccgggtttaccccgtttaaccccggttccccccgttccggtaaccccttaaccccgtcccccggtaacgacctacccgtacccgg

SEQ ID NO: 142776 - DNA, 586 bp, Homo sapiens
  misc_feature: GYAE6OF02JZUBW.46.67.G01.1.454.CMB.1.raw
  modified_base (97)..(97): a, c, t, g, unknown or other
  misc_feature (97)..(97): n is a, c, g, or t
  modified_base (166)..(166): a, c, t, g, unknown or other
  misc_feature (166)..(166): n is a, c, g, or t
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (567)..(567): a, c, t, g, unknown or other
  misc_feature (567)..(567): n is a, c, g, or t
tcagactagcagtacacgaccggtgctcgatttagagtatacatattgggtttggggagtctcggtcaggacacagcatggacatgagggtccccgntcagctcctggggctccgtgctacgtctggctccgaggtgccagatgtgacatcgagctgaccctgtcncctatccctcctgtctgacaaccggtgggacacagttcgtcaccntcgacgttgaccgggcaaggttccggaacnttacgactacttatttaaagttggtatcaacntacgcaggacggtccctagactacctaatctatcgctacgcactcctagttgacaaggtcgggtccatcgaggtcaggtgcgagtggtatcgtaggactagactttcactacncccgtanatctaagtactntacgacgtagtacgttaaggctttacgtactaacttagttacttactacgtacaagtaattctaagtttcgttacggaaccgagtaaccgaagtaacgtaactaaaacgtacgaacgttagtacgtagtctacgtacctaagtcctagttcctagtcttacnccgttactatcttacgtac

SEQ ID NO: 142777 - DNA, 918 bp, Homo sapiens
  misc_feature: GYAE6OF02HA63S.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgacaaccggtggganacgagtgtcaccatcctacgttcggcccgggactaaaggtccgggaaactagtttacgaacctaacctttaattttaaaagttcgggtaattaccgaaaacctaagttaacggaaccccgtaagggggtaacccgggaccccccgttaaaggtcccttacccttaaaacgttaccgttaacttacgggtacctcggtaccaactttaccccgtaaggtttttacggaaccgtaaaaacgggttcggggggttacccctaacggttaccgggtaaggggttttaccgaagggtttcggggaccgtaaggggtttacggggtaacttcccgggttaacgggggtaaacctaacggggttaaaccttttttcccgaaacccggttttaccctaaccgtaaacccccgttaacgtttaacccgtaacgggttttaaaaccttcccgttacggtaaacccgtaaaccgggttaaggttaaacggtttacgtttttacggaaccctttaaacgtttacgtttaaccgttacgttaacctaaacgtaagttaaactttacgtaacgttttacgggtttaccggaacccggtaaggtaccctaacggtaaccttaaaccgttaaaacgttaaaccgagttacggtacggaccgtcgtaacctaacctacgttacgttacgttaccgttaccgtaacgtttcccgttccctaccgtacttacgtagttaaccg

SEQ ID NO: 142778 - DNA, 721 bp, Homo sapiens
  misc_feature: GYAE6OF02HGD5T.46.67.G01.1.454.CMB.1.raw
  modified_base (123)..(123): a, c, t, g, unknown or other
  misc_feature (123)..(123): n is a, c, g, or t
  modified_base (141)..(141): a, c, t, g, unknown or other
  misc_feature (141)..(141): n is a, c, g, or t
  modified_base (158)..(158): a, c, t, g, unknown or other
  misc_feature (158)..(158): n is a, c, g, or t
  modified_base (220)..(220): a, c, t, g, unknown or other
  misc_feature (220)..(220): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactcnggctcgagtgccagatgngacatcgagctagaccngtctccatcctcctgtctagcaacggtggagacagtgtcacctatcgtacttcggccggtanagtcgaatattcgacctaaccgttaatttaactggtaactacaactaacgtagaaccgtaagggaccgtaccccgtaaagcctaacctaacgtactatacgcgttagacctaagtcccgtagtttacgacgaaacgggtccgggtaccctagttacggtacgttacgaaggttcggactaggttacgatttccggagggaactaagtctttacgacttactacgacctagtccgtaagtacgtctacgacgtaacgtacgttaagtctttaggactaacgtttntactaacgtaccaaagtacgtaaccttaagtacgtttacggttccgggttaaaccaacgggtacctaaaacggtaacccttaaagttaaaaccgtaaaggaacccgtttagacggacgtttaccggaacctaccgttaagttcccgtttaacggacgtttaacctttaccggtacccttttaacccgggtaccctaaacgtcccggttaataacccg

SEQ ID NO: 142779 - DNA, 703 bp, Homo sapiens
  misc_feature: GYAE6OF02F9PLX.46.67.G01.1.454.CMB.1.raw
  modified_base (696)..(696): a, c, t, g, unknown or other
  misc_feature (696)..(696): n is a, c, g, or t
tcagactagcagtacacgaccggtgctcgatttagagtatacatattggggtttggggagtctcggtcaggacgcagcatggacatgagggtccccgctcagctcctggggctcctgctactctggctccgaggtgccagatgtgacatcgagctgacccagtctccatccctccctgtctgacaaccggtgggagacagtgtcaccatcagttcgccgggcaaggtcggaactattcgactacctaatttaaagtggtaatcaactatacgactagggaccgccccgtaagcctacctaatctattgctgcatccgtagtttcgacgtaaacggtcgggtacccagttaccggtaggtttccgaaggttcggacctaagggtggaacttcggtaggggaactaggttaactttacaccttcgtaccgtaacctacgtacctaggttaaacttaccgtacggtaacctaaacggtacgtaaagttattttacggaacttaaacgttttaactttacggttaactaacgtaaaccgtaaagttaaactttaacgtaagtttcggttttaccggaaccggtaaagggtaacctaaccggtaaacttaaaccgtaaaacgttaaacgtaacgtagtcggtactacgacctaactacgttcttagttacttacgtactcccgttacccgtactacttacngtaaccg

SEQ ID NO: 142780 - DNA, 884 bp, Homo sapiens
  misc_feature: GYAE6OF02I2KB4.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggccacgactgggtgaggcctttcggacgaccctgtcccctcacctgcgcttgtctctggtcgccttcatcaggttagttcggtttccttcggtacggggcgttcggggtccggcaggtcctaccccggaggggaacgggggtcgttacgggaaattaacctaggttacgggaaagttcggttctcctactagttacgggttgggtaccgggttttaccttaatttacggtacgtttcccgtcgttacctacgtaaaggtacggtcgtacgttacacccttaattacttcctacgttcgggaacctacccgtaccgaacggtacctaacgttcctttaaccgtttttcccgaaggtaaacgtcttaggttacgtttccgttacggttcccggtaacccggtccccggtcgttacggtaaccggtacccggggtttacgttttaacgtttacggttcggttacggtcggtaacgggtacgggtaaccggttactttaaccgttttaggttacggtttttaggttttttacgggtacgggtttttagggttttaacgtttaccgttaaacccgttaacccgttaagggttaccgggttaccgggtaccggggggtccccgtttaaccgggggaccccgggtttaaccgggggaccggttaacgggttaacggttaccgggttcgttacccgggttacccgttcccgttacccgttaccggtccctaaccccgg

SEQ ID NO: 142781 - DNA, 704 bp, Homo sapiens
  misc_feature: GYAE6OF02HWPM1.46.67.G01.1.454.CMB.1.raw
  modified_base (173)..(173): a, c, t, g, unknown or other
  misc_feature (173)..(173): n is a, c, g, or t
  modified_base (389)..(389): a, c, t, g, unknown or other
  misc_feature (389)..(389): n is a, c, g, or t
  modified_base (613)..(613): a, c, t, g, unknown or other
  misc_feature (613)..(613): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctggtcncctccatctaggtagttggtttcttcggtggggtcgtcgggtccggcacgtcctcccggaggggagggtcaggaatacagttggagtgtctctcgtaagtaggtggtacggttcctattacgacgttccgtctctagacgtacggttcgacgttaccaactatacgtctcgtacggtactacgtaccagactaactccttcgtttaccgagaagtnttcgtccgtttgtcggtccgaccggtccgtacgtacggaccggttacggtttacctttaagttacgttggtacggtacggagtacggtacggtatttactgtttaggtttagttttaggttaggttacgtttacgttacgtaccgtaccgtagtaccgtcggggtaccgggtccgtaccggacccggtacggggaccgtaaaggacgttaccggtccgttaccnccgttacctccgttacctacccgtaccgacggacgtcctacgtcccttacccgcccgttacgcccgtaccctccacggtacaccgtacccg

SEQ ID NO: 142782 - DNA, 828 bp, Homo sapiens
  misc_feature: GYAE6OF02JXTRO.46.67.G01.1.454.CMB.1.raw
  modified_base (399)..(399): a, c, t, g, unknown or other
  misc_feature (399)..(399): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctcgtggtcgccctccatcaggtagttcggtttcttcggtcggggcgtcggggtcccggcacgtcctaccccggaaggggggaacgggggtcttagggaaacttacgacggtttaggaacggttcgtacttcctactaagttagggttaggtaccggtttaccttaagttaccgacgtttcccgtactctacgaaggtacgtccggtagtcaccgtatactcgtacgcggtaccncgtaccagctaacttcttacgtttccgaggaacgttgtagttacgttccgtaggtccggaccgtcgtcgtacggaaccgttccggttattttacgtcggtcgtacggacggtagtacgggtacgttacgttagttacgtttagttaggttttaggtaggtttacgttacgttaccgtacgttaaccggtagtaccgggtacgggtaccggggtccgttacccgggtccggggtaccggggtaccgtaagggtaccgttacggttacccggtaccggttacccgttaccggtttacccttaccgggtacccccgtaacccgtaacccggggtaaccccggtaccggttacccgttccccggtttcccccgttacccggtcccgtaccccgtaccccttacccggacccgttacggaccccgttacccggg

SEQ ID NO: 142783 - DNA, 786 bp, Homo sapiens
  misc_feature: GYAE6OF02IEKER.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgacggccttcggacgacccctgtcccctcacctgccgtctggtcctcgtcgggtcaccctccatccaaggttagttggtttccttcgngggggccttcggggtcccgctacggcctcccggaaggggtaggggcctagggaactactaggtttagggaacgtgttctctacgagttaggtggtacgttctacttacgacgttcgtctctacgaaggtacgtcgacgttaccgaacctattacgtcgtcgtacggctaccgtcacgtataacttcgttaccgttttccaggaacgtgttacgtagttctaggtacgcccgcgtctacggtaccggtacggtttacgtttaacgttcgtcggttcggacgtaagggtacggtacggttactttacgtttaaggttcgttttaagggttttacgggtacggtttttaccgggtttacttaaccgggtaaccttacccggttagacccgggttaccggggacgggtcccttaccggtacccgggtaggggtacccgagggtaacgttcgtacggtcctaccgttcgttaccgtccgacccgttacccgacggtaccggtacccgtacgttccccggttcccgttaccccggcggttacccccacccgttcccaacgtaccggtcctacccgg

SEQ ID NO: 142784 - DNA, 753 bp, Homo sapiens
  misc_feature: GYAE6OF02JYIND.46.67.G01.1.454.CMB.1.raw
  modified_base (596)..(596): a, c, t, g, unknown or other
  misc_feature (596)..(596): n is a, c, g, or t
tcagactagcagtacacgaccggtgctcgatttagagtatacatattgggtttgggggacctcctgtgcaagaacatgaagcacctgtggtttgtcctcctgctggtggcagctcccagagtgggtcctcgtccctggtgcaacctgcagggacgtccgggcccacgacgtgggtgaggtccttcgggagaccccgttgtcccctcgacctgcgcctggtctcgtggtcgcctcatcaggttagttggtttcttcggtgggggtccgttcggggtcccggacgacgtccgtacccggaaggggaacgggggtcgtagggtaaatacgtagttagggtaaggtcgttaccgttcgtacgtaagttaacgggttcggggaacggtttccctttaaggttacgtaacccgttccggttcctaccgtacgtaaagtcgttacggtacgtacctacctacttactctacgtacggactaaccggtacacgactaactacgttacgttttccaacgtaagtagtacgttagtttccgtacggtccgtaccgcgtcgtacggtcggtaacggttactttagttctgtggtagaggcgtacgtntaagttcgttcgttagttttagggtagttcggttcttaacgtaccgttacgtacggtagtccgggtacgggtccgtacccggtccgggtccgggtaacgtaaccgggtataccgggtacgttaccgacgttcccgtagttacccgtccgtaaccccg

SEQ ID NO: 142785 - DNA, 676 bp, Homo sapiens
  misc_feature: GYAE6OF02IYE87.46.67.G01.1.454.CMB.1.raw
  modified_base (97)..(97): a, c, t, g, unknown or other
  misc_feature (97)..(97): n is a, c, g, or t
  modified_base (121)..(121): a, c, t, g, unknown or other
  misc_feature (121)..(121): n is a, c, g, or t
  modified_base (135)..(135): a, c, t, g, unknown or other
  misc_feature (135)..(135): n is a, c, g, or t
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (381)..(381): a, c, t, g, unknown or other
  misc_feature (381)..(381): n is a, c, g, or t
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgntcagctctggggctcctgctactntggctccggaggtnccagatgtgacatcgagctgacccagtctccatcctcctgtctgcaaccggtggacacagtnccaccatccattgcccgggntaagtcggaacnttcgactacttaatttaatgtatacaanattacgaccacgggacggccccctaaggcttaccgaagtcctagacgcctaggcctatccgtagtttacgacgaaaggtcgggttaccagtccggtagttcgaggtggctagttggacttcggngggtaaacagtacgtttccgaattaccctacgaacccgtntaccgtaagtacgtctagaccttaacggtagtacgtagtttagtacctaaactttacgttaacgtcgttaacgtaacgtaattaaacttaccgtaagttttcggttaaccgtaccggtaaggtaccgtaacgttaaacgtaaccgttaaaactaacgttaaaactggttaacggcctaacggacgtaacctacgtattaccggtttaacctacgtacgttacccggttaccctaccgacgtttccgagttaaccg

SEQ ID NO: 142786 - DNA, 604 bp, Homo sapiens
  misc_feature: GYAE6OF02GEJSJ.46.67.G01.1.454.CMB.1.raw
  modified_base (210)..(210): a, c, t, g, unknown or other
  misc_feature (210)..(210): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttggagaccctgtccctcacctgcgctgtctctggtgcctccatcagtagtggtttcttcgtggggctgggtccggnagctcccgagggagggctaggaatacagttggaagtgtctctcataggtgaggttcctattacgagtccgtctcgtcaagtagtcgagtcaaccgatatctgtaggacacgtccagcaatcagttttcccagtaacgntagagttactgtgaccgcgtctgacgacgggtattttatacgtgtgcgagagacgtactattatgtattttggagttgttattacgactaccgtagagtcggacgggtctccgacccgtggggccgaaggggtaacttacgtcggtacctaccgtcttaccgttacgccctaccgaaccgtaacggccctaaggttcccggttccctttaccccggtacgcccgtaccccttacccgaccgtacgacgtaacccgg

SEQ ID NO: 142787 - DNA, 844 bp, Homo sapiens
  misc_feature: GYAE6OF02G5XFN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggacgacagtgtccaccatcacttcgggccgggacaacggtaccggaactacgttcgaacctaaccttaattttaaagttggtactacaaactataacgaccgaagggaccggcccctaaagcctacctatctagtgactgctagtacctaggtttacgacgtaaacgggtcggggtacccaggttccggttaagggtttaccgtaagggtcggtaaccggtagggttacgggtaagttccgggttacggggtaaactaacgggttaacttttaacccgtaccgtttaccctacccgtaaacccgtaacttaaccggttaaacgtttaaccgttaccggtaacggtaaccgttaaaccggttaggttaaacggtttaacttttacggaaacctttaaacgtttacctttaaccgttacggttaaaccctaaaacgtaacgttaaactttaacgtacggttttaaccggttttaaccgggaacccggtaaacggtaacgtaaaccgtaaccgttaaaacttaaaaaccggtttaaaaccgttaacgttaacgggttcggtaccttaacgggaccctaacggttaaccttccggttacgttaccgtttccgtaaccgttccccttaacccgtacccgttattacggttacctaaacg

SEQ ID NO: 142788 - DNA, 707 bp, Homo sapiens
  misc_feature: GYAE6OF02H5THR.46.67.G01.1.454.CMB.1.raw
  modified_base (152)..(152): a, c, t, g, unknown or other
  misc_feature (152)..(152): n is a, c, g, or t
  modified_base (194)..(194): a, c, t, g, unknown or other
  misc_feature (194)..(194): n is a, c, g, or t
  modified_base (481)..(481): a, c, t, g, unknown or other
  misc_feature (481)..(481): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcganctgacccagtctccatcctcctgtctgaccaaccggtggganacgagtcgtcacatctacgttcggccgggacaaggtcggaacagttgacctaccttaatttaagttggtaatcgaataagtaagaccgtaacggggaccgtacccctaagccttaccttaactactatcggtactcgactactccgtagtttgaacgtaaacggggtcgggtccctagtccggtaggttcgagggtcggcgtaggtcggtatcggtagggactagtactttacacgttacctacaactactacgtaagtaactcgtacgaactaaggtagtaagttntttacgaacttacttaagttactcgtaacaaactagttaaacttacggtaactttcggttaaccggacgtaacgggtaactaaccggtaaacttaaacgttaaaagtaaaccgttaacggtcggttacgaccgtaccgtaacctacgttaacccgttcgtttaaccttcgtttaacccttaccgttaccccgttacccccgtacgtaacttcccgtaaggttaacc

SEQ ID NO: 142789 - DNA, 751 bp, Homo sapiens
  misc_feature: GYAE6OF02FK8MP.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcctacgttggcccgggacaaggtaccggaaactagttacgaacctaaccctttaagttttaaaagttggtaacttaccaaacgtattacggaaccgaacggggtacccggtaccccccttaaaggtcccgttaccttaaacttaccgttagttcgtaccttcgacctaacgttcccgtaaggttttcgaacgtaaacgggttccggggttacccctaagttaccgggtacggtttaccaagggttcggacgtagggttcggtactaccgggtagggaactaggtactttacctacgttcctacctaacctattacgtaagttactcgtacgtaacgtacgtagtaacgttagtttacgaccttaaactttattacgtacttaacgaaactaggttaattacttaacgtttcgtttaccggaacgtacggtaactacgtaacttaaactaaacgttaacgtaacgttggtcgtacgtacgaacctaccgttactcgttacttaccttctactttccttccgtaccgtaccttacgttcgttaaccg

SEQ ID NO: 142790 - DNA, 648 bp, Homo sapiens
  misc_feature: GYAE6OF02F3EBC.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccgtggganacagtgtacaccatcacttggcccgggcaaggtccggaacagttgactaccttatttaaatggtatacaacatagaccgagggaccggcccctaagctactaatctatcgctgctatccagtttcgactaaaggtcgggtacccatccggaggttcaggtcggcgaggtggtatcggtagggtacagtagtttacacttctaccaacctatactaagtaatcgtgaccgtaacggtagtaagttaatttttcggaacttaaccgtttaattaaccgttacgtaacctaaaccgtaataaacgtttaactaaacgtttcggttttaccgggaccgtaacgggacctaaccggtaacttaaaccgtaaaacttaaacggtaacgtagtacggtactacgactaacccgtattccttacgttccttactacttcccttacccgcctagttcctagtac

SEQ ID NO: 142791 - DNA, 634 bp, Homo sapiens
  misc_feature: GYAE6OF02IJD2Y.46.67.G01.1.454.CMB.1.raw
  modified_base (109)..(109): a, c, t, g, unknown or other
  misc_feature (109)..(109): n is a, c, g, or t
  modified_base (124)..(124): a, c, t, g, unknown or other
  misc_feature (124)..(124): n is a, c, g, or t
  modified_base (170)..(170): a, c, t, g, unknown or other
  misc_feature (170)..(170): n is a, c, g, or t
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (380)..(380): a, c, t, g, unknown or other
  misc_feature (380)..(380): n is a, c, g, or t
  modified_base (607)..(607): a, c, t, g, unknown or other
  misc_feature (607)..(607): n is a, c, g, or t
tcagactagcagtacacgaccggtgctcgatttagagtatacatattgggtttgtcctcctgctggtggcagctcccagatgggtcctgtccctggtgcaactgcaggntcggccacgctggtnacggtccttcggagcctgtcctcaacctggctctgtcctctggtcncctcaatcagttagtcgttctgngggctgggtcanacgctccggagggaggctaggatacgtgtaccggagtctctnctaagtgtgtacgttctactactcggtcctctactacgaagtcgtacgagttacnctaagtctctcgtggaccnctccgagactaacttctacgttaccaggactacgtcgtagtcgtacgtcgccgtcggtnttacgacgtcggtactttagtcgtggtgtaacgtacgcgtacgtcttaagtagttagtttaccggtttaggtgtttaccgttagttaccgtacgttacctaggtaacggttcggaccgggtacttcccgacggttcggaccgtagtaactcggttacgacggtctcgttaacgtctccgtaacgtacgaacggtcctacgttccggtccctccgtccggttaacccnccgttacccgacttacgggctcccggg

SEQ ID NO: 142792 - DNA, 668 bp, Homo sapiens
  misc_feature: GYAE6OF02JDRSB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggacgacagtgtccacatcacttgccgggacaagtcggaacattgactacctatttaatggtatcaacatagaccagggaccgccctaagctacctaatctatgctgacatcctagtttcgacgtaaaggtcgggtacccagttcgacggttcgaggtcggacgtaggtgggtactccggtagggaactagtactttacacttccgtacctacctattaccgtaagttaacttcgtacgtaccgaaacggtacgtaagtttactttcgaaccttaaccgttttaagttaccgttagttaacctaaacgtaagttaaactttaactacgttttacggttaccgggtaaccgtaacgggtaacctaaccggtaacttaaacgttaaaacgttaaaccgtacgttagtacggtactacggacctaccgtattactcggttacttactacccgtttacgcccctaactacgttcctaagttcg

SEQ ID NO: 142793 - DNA, 731 bp, Homo sapiens
  misc_feature: GYAE6OF02FLOL4.46.67.G01.1.454.CMB.1.raw
  modified_base (196)..(196): a, c, t, g, unknown or other
  misc_feature (196)..(196): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgacaaccggtggagacngtgtaccacctatccacgttcggcccgggactaaggtaccggaaactagtttcgaaccctaacctttaaagttttaaagttcggtaaacttacaaactagtaacggaacccggtaacggggtaacccggacccccgttaaaggtccttaaccttaaactccgtacgttaggccttacggactacgttaccgtagtttacggacgtaaacgggtcgggtaccctagtaccggtacggttcgtacggtcgacgtaggtacggtactcggtacgggactaagttacgtttcgaaccttcgtaaccgtaacctacgtacgtacgttaatcgtacgtacgtaacgtagtaagttatttacgacttaacttagttaaccgtgtaactaacgtaataactttagtacgttcggttaccgaacggtacgaccgtaacgtaactaaacgttaacgttaaacgacgttgacgtctacgacctacgtacgttccttacgttaccttacttaccgttcccgttacccgcttacgttccttagtaccg

SEQ ID NO: 142794 - DNA, 784 bp, Homo sapiens
  misc_feature: GYAE6OF02H41TW.46.67.G01.1.454.CMB.1.raw
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (418)..(418): a, c, t, g, unknown or other
  misc_feature (418)..(418): n is a, c, g, or t
tcagactagcagtacacgaccggtgctcgatttagagtatacatattgggtttgggggacctcctgtgcaagaacatgaagcacctgtggtttgtcctcctgctggtggcagctccccagatgggtcctgtcctggtgcaactgcaggagtcgggcccacgactggtgacggcctttcgggacgaccctgtcccctcacctgccgctgtcctcgtggtcncctccatcaggttagttcggtttcttcgtggggccttcggggttcccggacncgcctcccgaaggggaacggggtctaggaatacgagttaggtaagtcgtcttcgtactagttaggtgggtacgtttccttaagtttaccacggttccggttctccgtacgaaaggtacgtcggacgttcaaccctaattaccgttntccgtaggtacaaccggttacccaaagcctaaacttaccgttaaccgtttttcccgtaggaaacgttgttagttaacgttttcgacggtttccggaccccgtccggtccctaagggacccggtttaacggggtcttttttaacgtacggttggtacggacggaagtacggcccgttaagtttaattagttaggtttagttttacgggtagtttacgttttacgtacctaaaccgtacgttaggttacgccggggtaccggggttccgtaaccccggttcccgggcggggtaaccgttaagggtaaccgtttacggtcgggtttacccacccggtttcccgttacgttaccccgcccggttaacccg

SEQ ID NO: 142795 - DNA, 660 bp, Homo sapiens
  misc_feature: GYAE6OF02HE5PX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctggggtccggcagcctcccgaggggagggctggaatacagttggaagtcgtctctcataggtggtaggttcctattacacgtccgtctctcaagtagtcgagtcaccatactctctggacacgtccagctaatctacgttttcccaggaatatagtagttcgtgtacgacccggccgcgtcggaaccgtacggggttacttttattaccgttggtcggacggagtaacgggtaccggtcttaatttagttacgtttagtttttgggtaagttttaggtttacgtttccgaaccttacccgtagtacgtccgggtaccgggctccgaccccggtgggaccgaagggtactacgtcggtacctaccgttcgtcccttacgccctaccgaccgtaaccgggtccctagtacccgttcccttccccggtcgtccctcccgtaccctaccgtacggctacccg

SEQ ID NO: 142796 - DNA, 809 bp, Homo sapiens
  misc_feature: GYAE6OF02IHLRL.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggacgaccctgtcccctcacctgcgctgtctcgtggtcncctcatcagttagtgtttctcgtgggtcgtcgggtccgcacgctccggagggaggcgtagactacgagtggagtgtactctgagtaggtggtacggtttacctaagttaccacggttccgtactctacgtaacgtagtacgacgttccaactatactcgtcgtacgtaacgtaccgtacacgtactaacgttccgttaacgttttacccgtaaggtaaaccggtagttacgtaacgttttccgttacggtaccggtaacccggtccgtccggtaacggtaaccgggttacccggggtttaacgtttttaaccgttaccgtagggttccggttaaccggaacggtaacggtaaccggttctttaaagtttacggttagtttaaccggttttttagggtacgttttaggttttaaccgtttaccgtaaccgttaaccggttaacgttacgggttacccggggaccgggttcccgttaacccgggtacccgggttaccggggtaaccggtaaacgggttaacgtttacccgggtaccggttaccggttaccccgttaaccgtttacccgttacccggtaccccgtttaacccccgg

SEQ ID NO: 142797 - DNA, 733 bp, Homo sapiens
  misc_feature: GYAE6OF02IA7DM.46.67.G01.1.454.CMB.1.raw
  modified_base (717)..(717): a, c, t, g, unknown or other
  misc_feature (717)..(717): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctcgacccagtctccatcctccgtgtctgcgaaccgtgggacacaggtcgtccaccatctacgttggccgggtctaagtcgggaactacttagcctaaccttaatttaacgttagtactaccgtaacacgttacgaccgtagggaccggtaccccctaagaccgttaccttaacgtactaatcgcctgactacctacgtacgttttacgaccggtaaaggtaccgggtccctacgtacggtaggttccgtaggtcggacgtagtagggtataccgttagggacgtaacgttcgtttacgacgtttccaccaaccgtgtacctagtaacgttcctagtaccggaacggtttacgtaatttacgtttacggaacttaacgttttaactcgttacttaacgtacgtaaacgttacgttaacttaacgtttgtttccgggaaacggtaacccggtcaacgttaaccggtaaaactttaaagtaaaaccggtacgttaactagggtacctaccggacgttaaccgtaacgttcgttacgttactttactaccgttcctaaccccggttntaacgttactacgtac

SEQ ID NO: 142798 - DNA, 587 bp, Homo sapiens
  misc_feature: GYAE6OF02JC98J.46.67.G01.1.454.CMB.1.raw
  modified_base (193)..(193): a, c, t, g, unknown or other
  misc_feature (193)..(193): n is a, c, g, or t
  modified_base (424)..(424): a, c, t, g, unknown or other
  misc_feature (424)..(424): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctnacctgcgctgtctctggtcgcctcatcagtagtgtttcttcgtggggctggggtccgcagcctccgagggagggctggaatactagttacggaagtgtctctcataggtggtacggttcctaattacgtacggtccgtctcctacgaaggacgtacgacgtaccgacctatacttctcgcggtacaccgtacagactaatcgtacgtttccagtagatgtagttctgtacnccgcgtctcgacgtacggttacgtttatacgtgtgacgagacgcgtattacgttattgttagtttggagtttgtttattcgactacctagacgtcgggacggcgtcccggcccggtaggccgaaggtctacgtcggtctcccgtctaccgttcaccgtacccg

SEQ ID NO: 142799 - DNA, 614 bp, Homo sapiens
  misc_feature: GYAE6OF02JNICH.46.67.G01.1.454.CMB.1.raw
  modified_base (97)..(97): a, c, t, g, unknown or other
  misc_feature (97)..(97): n is a, c, g, or t
  modified_base (190)..(190): a, c, t, g, unknown or other
  misc_feature (190)..(190): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgacccagtctccatcctcctgtctgcaccgtggganacagtgtcaccatcacttgccgggtcaagtcgaacnttgactacctatttaatggtatacaactatacgaccagggaccggacccctaaagctacctaatcctatcgtctgcaatcctaagtttcgacgaaacgttcggggtaccctagtcgtaggtttcacggttcggctaagtgggactcggtagggactacggtactttacgacttccgtacaccgtatacgagttaactccgttagacgaaccggttgtaagttaacttttgacttaaacgtttactacgtagtacaacgtaagtaacttacgtaattcgtttacgacgtacggtactacgtacttaaacaaacgttaaacgactagtacgtactagtacaaccgtatctactccttactacttccgtaccgtactacgttactagtaac

SEQ ID NO: 142800 - DNA, 791 bp, Homo sapiens
  misc_feature: GYAE6OF02GJE6E.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttcggagacccctgtccctcacctgcgctgtctctggtgcctccatcagtagtgtttcttcgtgggctgggtccggcagcctccgagggaaggggctaggaatacagttaggaagtgtctctcatagtggtaggttcctattacgagtccgtctctcaagtagtcgagtccacatacttctcgtggacctacgtccaagctataccttacgttttccctagaactagtacgtagtttactggtaccgacccggccgtcgtacggaaccgtacgggttccttttaagttacgttcggtcgacggaaggaccggtacggtactttagtttacgttaggtttagtttttagggtaggttttacgggttttacgtttaccggttaacccgtaacccgttaggtaacgggttcccggggtaccgggggtaccgttaccccgggtaaccccggggttcggggacccgggtaacgggttaaccgggtttccgttacccggggttcgtaccccggtttcccgttacccgtttaccgccccgttaccccgaacccggtaacccgggtccccttaaccggttccccggtttcccccgttacccccccggtccggttaacccccgtcccccgttaccccgtttaacccgaaccggtacccgtacccccgg

SEQ ID NO: 142801 - DNA, 860 bp, Homo sapiens
  misc_feature: GYAE6OF02IUVH4.46.67.G01.1.454.CMB.1.raw
  modified_base (80)..(80): a, c, t, g, unknown or other
  misc_feature (80)..(80): n is a, c, g, or t
  modified_base (844)..(844): a, c, t, g, unknown or other
  misc_feature (844)..(844): n is a, c, g, or t
tcagactagcagtacacgaccggtgctcgatttagagtatacatattgggtttgtcctcctgctggtggcagctcccagntgggtcctgtccctggtgcaactgcgagggacgtccgggcccacgtacgtgggtagacgggtcccttacgggacgtaccccgttggtcccctcgacccgttggccgtccgttgtcctcggtcggtacgcccctctaacgtccgtaggttacgttcggtttccttcggtacgggggtcgtaccggggtccggacgtacggtcccgtaccgggagggggtaacgggtcctaaggtaactacgtaggttacgggaacgttcgttccgtacgtacgtacggttacggtacgggttaccgttaccgttaacgttaaccggttccggttccctaccgttaccgtaacggtaacggttaccggtacggtacccggttaacctaacccgttaaggttcctaccggttacgacggtaaccgtaccgtaccggtaacaccgtaacgttccgttaaccggttttaccgacggtaaacgtgtacggttacgttaccgtcggtaccgaccgtccggtacggtacggtaccgtacgggtttacttacggttacgcgtaacggtcggaagtaccggtacggttacgttacgttagttaggtttacgttgggtacgtttacgtacgttccgaaccgtcgttacggcggttacggcgtacccgcgttacccgggacggtacgtaggtaccgttcgtcgtccgtacgaccttcgttaccgccctcggaaccgttccgccgttaccgtccgttcccgacccgcgtacccgtcctaccgggtanacggttccctaccggg

SEQ ID NO: 142802 - DNA, 787 bp, Homo sapiens
  misc_feature: GYAE6OF02JZFQ3.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggacccagactggtgaggtccttcggagaccctgtccctcacctgcgctgtctcgtggtgcctccatcagtagtcggtttcttcgtcggggtctcggggtccgctacgcctaccccgaaggggtaacggggtcttagggaaataccgtaaggttgggaaaagttcggtaccttccttacgaagttacggttagggtacggttaccctaagttttaccgagttcccggtcttactacgaacggagttacgacgtacctaccaattcgtactcgaggtaccaccgttaccgagactaaactcgtaaccgttttcccgaaggaccgtaagttcgtacgttaccgttggaccgaccgtaccggctacggtaacccgtcggggtaccttttaacttaaccggttggtacggtacgtaacgggtaacgggtacccgttagttaacgtttagtagtttaacggttttagggtacggttaggtttactttagacccgtacgtaaggttccgtacgggccgggtcgtaacccggtcgggttcgggaccgtaagggtaactacggttcgtaccgtacccggtacttaacccttcgacccgtacgtacccggtcggtaccccgtacgtccggtttccctaccccggtctaccccgtaccttccgtaccgttaacgcgttaacccg

SEQ ID NO: 142803 - DNA, 729 bp, Homo sapiens
  misc_feature: GYAE6OF02I1OIK.46.67.G01.1.454.CMB.1.raw
  modified_base (278)..(278): a, c, t, g, unknown or other
  misc_feature (278)..(278): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgaccaaccggtgggagactagtgtccaccatctacttgccgggacaaggtacggtaaacattagaacctaaccttaatttaaaagttggtatacaanatacgaccgaagggaccgacccctaagtcctaccgtaaatcttaatcgactgactaatcccgtagtttcgaacgtaaaggtcgggtacccagttcggaaggttcgagtcggacaggtaggatcgtagggactagtaactttcgacttaccacaacctatacgaacgttaatctacgtaacgtaaacgtaggtaaagttattttagacctttaaacgtttaactttaacgtaacgtaacaaacgtaagttaaaacttaacgtaaacgtttgggttttaaccggtaaccggtaaacgggtaaccgtaaacgtaaaaccgttaaaacgttaaaaaacgttaaaaccggtaaacgttaacgggtaacgttaccgttacggtaacccaacgtaacgttacgttacgttactttacgttaccttaccgtttacccgaccttacttaccgtataaccg

SEQ ID NO: 142804 - DNA, 820 bp, Homo sapiens
  misc_feature: GYAE6OF02HJ2HA.46.67.G01.1.454.CMB.1.raw
  modified_base (289)..(289): a, c, t, g, unknown or other
  misc_feature (289)..(289): n is a, c, g, or t
  modified_base (810)..(810): a, c, t, g, unknown or other
  misc_feature (810)..(810): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtagacatcgagctacgacccagtctccactccctccctgtctgcaaccggtgggacactaggtgtccaccctatctacttcgggaccgggactaaggtacggaactattacggacctaaccttaagtttaaattggttactacaanactacgaaccgagggaccgtaccccgtaagtcctacctaactcttagtcgcctagactactccgtagtttcgacgtaaacggtccgggtacccagttaccggtaaggttccgagggtcggacgtaggtacggtatccggtaggtaacgtacggttaattcccgtaaccgttccctaacaccgtaatacgtaactttagtacctacggaacgttaaacggtagttaaaggttactttttaaccgaacctttaaaacgttttcttaaacgtttacttaaacccgaacgttaaaaggttaaaccttttaaaggtaaccgttttttggtttaaccccggggtaaaccgtaaacggggttaaacccaacgttaaaacccgttaaaccgtttaaaaaacggttaaaccgttaacgttacgggttaaccgtacgttaccgtaacccgtaaaccggtttacgtttaccgttaaccctttcgttaaccgtttaccttccccgttaccggtaaccctttcggttaccgttnttaaacccgg

SEQ ID NO: 142805 - DNA, 704 bp, Homo sapiens
  misc_feature: GYAE6OF02JLUUB.46.67.G01.1.454.CMB.1.raw
  modified_base (247)..(247): a, c, t, g, unknown or other
  misc_feature (247)..(247): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtgggctgggtccgcagctccgagggagggctggaatacagttggaagtgtnatcatagtcggtagttccgtattacacgttccgtctctacgaaagtgtaccgacgtaccaaccgtataactcgtcgtaggaacctacggttccaatcgaattccgtacgttttccccagaagtatcgtacttccgtggtacgacccgtcgacggtgaccgtagggttacttttaactcgttgtcggtagacgtaacggtacggtactttaattagtacggtttagtttgggtacgtttagtttacgttaccgacgtaccgttaaggtaacttcggggacgggtccgtacccgggaccccgggtaccgtaacgggacgttaaccgttcggtaccgtaaccggttccttaccggtacgtacccgtaccaacccgtaccgggcccctaaggttccccggttcccctttacccgtcggtacccctcccggtacctacccgaacgtacgttccccgtaccgg

SEQ ID NO: 142806 - DNA, 1113 bp, Homo sapiens
  misc_feature: GYAE6OF02HBJJC.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtcctccactccctccctgtctcgccgtaaccggtggggaacgtacgtaggttcgtaccaacctatacctacgttcggacccgggactaacggtaccggaactacgttacgacctaaccctttaagttttaaaacgttggtaacttacctaaactagtaacggaacccggaacggggtaacccgggaccccgttaaacggtaccttacccttaaagttaccttaacgtcggtaccgtgtaccccgtaacgttacccgtacggtttacggaccggttaaaacgggtttccgggggtacccctaaggttaccgggttaacggtttaccgacgggttccgggttaacggtaccggggttacgggtaaccggtttaccggttaacggggtaacgtttaacgggtttaccgtttttacccaaacccgttttcccgtaaacccggtaacccttaaccgtttaccggtaaacgttttaaaccggttaccgttaccggtaaaccggtttaaaaccgggtaacggtttaaaaccggttttacggtttttaaacgaaaacccgttttaaacgtttttaaaccgggttttaaccgtaaccggtttaaacccgttaaaaacgttaaaccggttttaaaaacgtttttaaaaccggttaaccggtttttttacccgggtttttaaaacccggggaaccccggggttaaaacgggggtttaaacccccgtaaacgggttttaaaaacccccgtttaaaaacgttttaaaaaaacccggggttaaaaacccgggtttaaaccgtttacggggtttaacccggtaccggtttaacccggtaaacccccgttaacccggtttaacgtttaccggttttccgttttaacccgtttaaccgtttaaccccgttttccccggtaacccccggtttaccctttaccggttttaaccggtacggttttaacccg

SEQ ID NO: 142807 - DNA, 803 bp, Homo sapiens
  misc_feature: GYAE6OF02IV8B7.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctcgtggtcgcctccgatcagtagtgtttcttcgtgggtcgtgggtccgcacgtcctccggaagggacgggtcgtaggtaactactaggttaggaagtgttcgtctctaagtagtaggtacgttacctaattaccgagttccccgtacttcctagtaagaggttaccggacttaccaccctaattacttccgttaccgtacgggaaccctaccggtaccctaagaccctaaacgttccgtttaaccgtttttacccggaagtaagtaacgttcggttagttacgttacggtaccggacccgtcccgtacgtaacggtaccggtacgggttacgttttagttactggtcggtaggtacgaaccgtacggtaacttaagtttacgtaggttttagttttagggtacgtttagttacgtttacaaccgttaccgttacgtacggtccggggtaccgggtcccgtaccgggtacccgggttccgggacccgtaaagggttaccgtaacgttcgtaacccggtccgttacccgttccgttaaccgtaccctaccgaaccccgggacggttacccccgacgtttccgttccccgtaccccgtcccgtacccttacccgtcccctaacccggacgcccgttaccgg

SEQ ID NO: 142808 - DNA, 664 bp, Homo sapiens
  misc_feature: GYAE6OF02GK3N7.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccggtgggacgacagtgtccaccatccacttcgccgggcaaggtcggaacattgacacctatttaatggtatacaacatagaccagggaccgcccctaagctacctaatctatgctgctactcctagttttcgacgtaaaggtcggggtacccaacgtcggtacggttcaggtcggcaggtggtatcgtgggactagtacttcactcctacacctactacgtaagttaactcgtacgaaccgtaacggttaggtaacgttagttttacggacttaaaccttttagttacttacggtacctaaacgttaacggtaaactttaacgtaacgttttcggtttaaccggaaccgtaacgggtactaaccggttaactaacgtaaaacgttaacgtaagttcgtacggtactacggacctaccgtacttacgtccttaacgttactaccgtttcccgtacccgaccttacgtaccgtagttaacc

SEQ ID NO: 142809 - DNA, 783 bp, Homo sapiens
  misc_feature: GYAE6OF02JYPNO.46.67.G01.1.454.CMB.1.raw
  modified_base (705)..(705): a, c, t, g, unknown or other
  misc_feature (705)..(705): n is a, c, g, or t
  modified_base (745)..(745): a, c, t, g, unknown or other
  misc_feature (745)..(745): n is a, c, g, or t
tcagactagcagtacacgaccggtgctcgatttagagtatacatattgggtttggggagtctcggtcaggacacagcatggacatgagggtccccgctcagctcctggggctcctgctactctggcctccgaggtgccagatgtgacatcgagctgacccagtctccatccctcctgtctgacgaccggtggacgacaggtgtacaacctatcctaccttgggcccggggactaaacgggttaccggaactaactttcgaacctaacccgttttaagttttaaaacgttcggtaaacttaccgaaacgtaacgtaacggaaccggtaaccggggtaacccggaaccccttaaacgaccttaccttaaacgtcgtagttcgaccgttacgtacctacgtccgttaacgttttacggaccgaaacgggttcccgggtaaccctagttaccggtaacggttacgaacgggttcggacggtaggttacggtaacgttcggtaacggtaacgtagtttaacgttaccgtaccttaactaaccgtacgtaacgttactaacgtttaactcccgtacggaacgtttaacggtacgtaagtttcgtttaacaactttcgtttaactacgtaactaaccgtaataaccgtaattacctaggtttacgaaccggtaccgtaaacgacgtactaaacaaccgttaaagttaaaccngttacgacggtccagtaccaacgtttctattcccgttaanaccgttacctaccgacgttacgttactacgtacttacg

SEQ ID NO: 142810 - DNA, 662 bp, Homo sapiens
  misc_feature: GYAE6OF02GYQO7.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacntgacacctattaacttggtatcaacatacgaccgagggaccggcccctaagcctcctaatctatgctgctatcctagtttgactaaaggtcgggtacccagtcggtacggttcagtcggcagttggactcgtagggactagtatttccaaccttcctacaaccctattaccgaagttaacttccgtacgaccgtaacgtaggtaaagttacgttttagaccttaaactttaactttaccgttacgttactaaactagtaaacttaacttaagtttacggttttaccggacgtaaacggacctaacgttaacctaaactaaaacttaaaccgtaacttacgggtacggtctacggtaccctaaccttacgtcttaccgttacctttaccgtaacctttccccgttacccgtaccctacgtttacctagttaaccg

SEQ ID NO: 142811 - DNA, 694 bp, Homo sapiens
  misc_feature: GYAE6OF02IGJJ4.46.67.G01.1.454.CMB.1.raw
  modified_base (206)..(206): a, c, t, g, unknown or other
  misc_feature (206)..(206): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccacgactggtgaggccttcggacgacctgtccctcacctgcgctgtctcnggtgcctcatcagtacgtgtttctcgtcggggcgtcgggtccggcagccgtcccgaggggacgggcgtaggaatacgtagtcggagtagtctctacatagtcggtagttcctaagttanacgttccgtacnctctaaggcgttcgacgtaccaaccgtagtactccgtacgtacggactaccggtcaagtacaacttcgtacttttacccgtgaacgtacgtttcgtaacgtttacctggttccgaccggtcccagttcggaaaccggtcgggttaccgtttttaagtaaccgttcgggagtaacggacgtacggtacgtaccgttaattacgtgttttaagttttcggaagtttcggtttacttgggtaaccctactacggtagttacccggggacggtccttaccggtaacccggtcgggaccgtacggtaacctacggttcgttaccggttaccgttcccgtacctttacggcccttaaccccgg

SEQ ID NO: 142812 - DNA, 718 bp, Homo sapiens
  misc_feature: GYAE6OF02HBEO3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgaccaaccggtgggacgacagtcgtccaccatccacgttcggacccgggacaacggtacggaactagttacgaacctaaccttaagttttaaaagttggtaactaccaaactagtaacgaaccgtaacggggaccgtacccccgtaagcctacctaatctagtcgctacgctactccgtagtttgacgtaaggtcgggtaccctagtcggtagttcgaggtggactaggtgatcggtaggatagtacttcgactctacacctatactaagtactcgtacgacgtaacgtagtaaactttagtttacgaaccttaaacgttttattacgttacgtaacctaaacgtaagttaaacttaacgttaagtttacgggtttaccggaaccggtaaacggtaccaaaccgttaaacttaaacgttaaaaccgttaaaccgtacgttacgtacggtctacggaacccgtaactaacgttccgttacgttccctttaaccgtaccttcccgttaccccggtactacgttacccgtagtttaacccg

SEQ ID NO: 142813 - DNA, 775 bp, Homo sapiens
  misc_feature: GYAE6OF02F4I6V.46.67.G01.1.454.CMB.1.raw
  modified_base (266)..(266): a, c, t, g, unknown or other
  misc_feature (266)..(266): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtcctccatccctccctgtctgcaaccggtgggagacagtcgtccaccatcacttcggccgggacaaggtcggaacattcgacaccttaatttaatggtatcaanatacgaccgagggaccgaccctaagcctactaatctatgctgactatcctagtttgaacgtaaacgggtcgggtacccaagttccggtaggtttaccagggttcggacgtaggttggacttcggtagggaactaggtactttacgaccgttacctacctaaccgtataccgaagtttaacctcgtacggtaacgtaaacggttaggtaaacttagtttttaacgaccttaaaacgttttactttaaccggtacgttaaccgtaaaacgttaacgttaactttaaaccgtaaggtttttccggttttaacccgggaacggtaaaccggggtaaccctaaacggtaaccctttaaaacggtaaaaaacctttaaacggtaacgttcgggtacgtaccgttacggaacccttaaccgtaacgtttacccggtttacgttacccgttttaaccgacccgtttttacccccgttaacccggaacccttacggttttaccctaaggtttaacccg

SEQ ID NO: 142814 - DNA, 850 bp, Homo sapiens
  misc_feature: GYAE6OF02JCE9A.46.67.G01.1.454.CMB.1.raw
tcagactagcagtacacgaccggtgctcgatttagagtatacatattgggtttggtcctcctgctggtggcagctcccagatgggtcctgtccctggtgcaactgcaggagtcgggcccacgactggtgaggccttcggagaccctgtcccgtcacctgcgtcctgtctctggtcgcctccatcagtagtggtttctcgtgggtctgggtccggcagtctacccgagggacgggcgtggaactacgagttggaagttcggtctcgtccagttacggtgggtaacggttccttattaccgtaggtcccgtacttcgtactaaggtacggttcggtacgtaccgtacctagttaacgtccgtccgtcggtaacctaaccgtccacggacctaaaacgtccttaacggtttttcccctaaggaaacggtacgttacgtaacggtttccgttagggtaccgacccgcgtccgtaggtaacccgtcggggttacgttttaacgttaccgtgttcgtacggaaccggtaagggtacccgggttacttaagtttaacgttaggtttagttttacgggtaggtttacgttttaaacgttcggtaacctttacccgtaacgttacggtccggggtaaccggggtcttaccccgggaacccgggttcggggaacccgtagggttaaccgttaccgttacgggttcccttaaccggttcccttcggttaacccgttcccttaccggaacccgggtaaaaccggtccccggttacggttaccccgggttcccgtttacccccggtacccggggtaacccctccccgttaccccggtaacccgtaggtaccccgttaacccgg

SEQ ID NO: 142815 - DNA, 693 bp, Homo sapiens
  misc_feature: GYAE6OF02GUK3X.46.67.G01.1.454.CMB.1.raw
  modified_base (684)..(684): a, c, t, g, unknown or other
  misc_feature (684)..(684): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgccgctgttcctctggtcgccctccatcagttacgtggtttcttcgtggggcttcggggtcccgcagtcctcccgaaggggaaggggctaggaactacgtagttcggaagttcgtactctacagttaggtcgggtacggtttccttaagttaccgtacgtcccgtcgtctacgaagtacgtccgtagtccaccattacttcctacgtcggactaccgtaccgagacctaattcctacgttttcccaaggaactagttaggttacgtttcgtacggtcgacccggtccgtacgtacgaaccggtcgggttacgttttaacttaccggtgtacggacgacggtacgacggtactttataggtcgtttaaggttttgggaagtttcggtttacttaccgaaccttaccgtagttacgccggggtaccgggtccgtccggtacccgggtggtaccggaggtactcgtacggtactccggttcctacgttcncccgtaccg

SEQ ID NO: 142816 - DNA, 885 bp, Homo sapiens
  misc_feature: GYAE6OF02JHJR1.46.67.G01.1.454.CMB.1.raw
  modified_base (180)..(180): a, c, t, g, unknown or other
  misc_feature (180)..(180): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgganaccctggtccctcacctgcgctgtcctctggcgcctcancgagtgtgtttctcgtgggcttggtcggcagctcccgagggacgggctggtaactactgttaggaagttgtcctctcgaacgttaggtacggacggttcctaagttaccaggttccgtcttactccgaaagtacggttccgagtacaaccgtaatacgtctacgtcggaactaccggtaccaaggactaacgttacgttaacccggtttttcccgaaggttaaccggtaacgtttacggttacgttttaccgttacggttaccggaacccggtcccggttaccgttggtaaacccgggtaaccggggtttaccgtttttaaacgttttaccggtaaccggttcgggaccggttaacggtaaccgggttaaccggggttaactttaaccggttttaagttaacgggttttaacggtttttacggggtacggttttaacgggttttacgtttaacccgtaaacctttaaccccggttacgtaacccgggtttaaccgggggtaccgggggttacccccggttaaccgggtttaccccccggggttacgggggtaaacccgtaaccggggttaaaccggtttaccggggttaaccgggtttaaccccggtacccgggtttacccgtttacccggttttaaccccgggcccccggttttaaacccccggg

SEQ ID NO: 142817 - DNA, 806 bp, Homo sapiens
  misc_feature: GYAE6OF02GAJ9G.46.67.G01.1.454.CMB.1.raw
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (207)..(207): a, c, t, g, unknown or other
  misc_feature (207)..(207): n is a, c, g, or t
tcagactagcagtacacgaccggtgctcgatttagagtatacatattgggtttggggatctcgggtcaggacacagcatggacagtgagggtccccgctcagctcctggggctcctgctactcgtgctcgagtcgccagtatgtgacgatcgagctcgaccngtctccatcctaccgtgtcngacgtaaccggtggacgtacacgtntaccaacctattaccgtacgtttcgggaccgggtactaaaacggtaccggaacttagttaccgaacttaaaccgtttaatttaaaacgttcgggtaaactacaaacgttacgtaagaacccgtaaggggtaaccgtaaccccttaaaaggtcttaacccgtaaagttaccgtaacgttacgaacgtcggtaaccctacgtacccttaagggtttaccgaacggttaaaaccggggttccgggtaacccaagttacggtaagggtttaccgaggtacggtaccgtaaggtttacggaaccttcgggtacgggaaacccgttaggttactttaccgacgttacctaccggaacttacgtaacgaagtacgtacgtacgtacgaacgttacgtaagttacttacgtaactaacttacgttacttacgtactaacgtaagtaacttaacgttacgttacgtttacggaaccgttaacggtaaactaacgtaacgtttaaacgtaaacgttaaacgaagttaacggacggtactaccgacgtaactaacgtacgttaacgttaccgtactacgttacgtacccgttacgtactacgtacgtaac

SEQ ID NO: 142818 - DNA, 667 bp, Homo sapiens
  misc_feature: GYAE6OF02JKRA3.46.67.G01.1.454.CMB.1.raw
  modified_base (184)..(184): a, c, t, g, unknown or other
  misc_feature (184)..(184): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
  modified_base (483)..(483): a, c, t, g, unknown or other
  misc_feature (483)..(483): n is a, c, g, or t
tcagactagcagtacacgaccggtgctcgatttagagtatacatattgggtttgtcctcctgctggtggcagctcccagatgggtcctgtccctggtgcaactgcaggagtcggcccagactggtgaggccttcggagaccctgtcccgtcacctgcgcctgtctctggtcgcctccatcagtntggtttctcgtgggctgggtccgcagtcctccgaagggacgggtctggaatcngttggaagtgtctncatagnggtagttcctatacagtccgctctacaagtntcgagtacacctagtactctcgtggaccacgtccagctaacttcgtaacgtttccccagaatgtagtacgtttcgtcgtacgaccgacccgtctacggaccgtacggttctttaactgtcgtggtacgacgtacgacggtacttataagttcgtagttttcgggagtttcgttaacgtttacgaccttaaccggngttaccgtcggggtaaccggtcgttaaccggaccgtcggggtaccgtaagggtacttaccggtggtaacgtacccggttacgttacgtaacgttccgaaccgtacccggtaaccgggtactcggtacccgttaccgtcccgtaccggtaccctacccgttaccgtccgtaacggtccgtacccg

SEQ ID NO: 142819 - DNA, 845 bp, Homo sapiens
  misc_feature: GYAE6OF02HY23I.46.67.G01.1.454.CMB.1.raw
  modified_base (130)..(130): a, c, t, g, unknown or other
  misc_feature (130)..(130): n is a, c, g, or t
  modified_base (178)..(178): a, c, t, g, unknown or other
  misc_feature (178)..(178): n is a, c, g, or t
tcagactagcagtacacgaccggtgctcgatttagagtatacatattgggtttggggagtctcggtcaggacacagcatggacatgagggtccccgctcagctcctggggctcctgctactctggctcgnggtgccagatgtgacatcgagctcgaccagtctccactcctcctgtcngacacggtggagacaggtctaccaccactacgtacgttccggacccgggctaacggtacgaacgtagttacgtaacctaacctttaagttttaaaagttacggttaataaccgtaaactaacgtaacggaacccgaacggggaacccggtaaccccgttaaacggcccttacccgtaaatttcctaagtcggtacctcgtaacctacgtttaccgtaggttttaccggaaccggtaacggggttaccggggtaccctacgttacggacggtcggtacgtcggtacgtagggtcggtacgtacggttacgggaatacggtactttaccgtaccgtaccttacgaccccatttaccgtaaagttaaccgttacgtcgggtaaccttaacgggttaacgggttaagttttacgtttaccgttaacccgtttaaacttttaccgttttaaccgtaaaccggttaacttaaacggtaagtttaacgttttaaaccacgggttttttaccggtttaacccgggaaccggtaacgggaaacctaccggtaaaccgtttaaaacgtaacgtttaaaagaaccgtttgggaacgtacgttacgaccgtaccttagttaccgtcgtttaaccgtccttaacggttcccctcccggtactacgttaccgtagttaacc

SEQ ID NO: 142820 - DNA, 723 bp, Homo sapiens
  misc_feature: GYAE6OF02FYOSB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgccaaccggtggagacagtcgtcaccatcacttgccgggacaagtcgaatattgactacttaatttaagtggtactcaacatacgaccgagggtaccgtaccctaagcctacctaatctatgtctggctactccgtagtttcgaacgtaaggtccgggtacctagtacgtaggttacgaggtcggagaggtgacgtacggtagggtactaggttactttccgacgttacctacccgtaactactaacgtaacgttacgttacgtacgtacgtaacggtagttaacggttacgtttacgtaacctttaacgtttacgtttaaccttacgtaacctaacgtaagttaaacttacgttaacgtttccggtttaaccggaaccggttaaccggtaaccgttaaccgtaaaccgttaaaccgttaaaaaccgttaaaccggttaacggttacggttaccggtacgtaccgtaccgtaaccttagttcccgtttaagttacccttactaccgtttcccgttacccaccgttacgttccgtacgttaaccg

SEQ ID NO: 142821 - DNA, 615 bp, Homo sapiens
  misc_feature: GYAE6OF02GEIDH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacattgactactatttaaattggtatcaacatagaccagggacgcccctaagctcctaatctaatgctgcatcctagtttgacgtaaaggtcggggtacccagtccggtaggttcgagtggctaggttggatcgtagggacaggtatttcacttctactaccatcagtaatcgtgaccaagtgaagttatttgactaacttattacgtgtacaactaagtaacttaactaagtttcgttttaccgaccggtaacggaacctaacgtaacttaaactaaaacttaaacgtaacttagggtcgtacgtcgacccgtaacctaacgttcgttacgttaccgttaccttaaccgttcccctttaccccggtacctacgtttaccgtacgttaaccg

SEQ ID NO: 142822 - DNA, 634 bp, Homo sapiens
  misc_feature: GYAE6OF02HVW0A.46.67.G01.1.454.CMB.1.raw
  modified_base (179)..(179): a, c, t, g, unknown or other
  misc_feature (179)..(179): n is a, c, g, or t
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
  modified_base (433)..(433): a, c, t, g, unknown or other
  misc_feature (433)..(433): n is a, c, g, or t
  modified_base (477)..(477): a, c, t, g, unknown or other
  misc_feature (477)..(477): n is a, c, g, or t
  modified_base (623)..(623): a, c, t, g, unknown or other
  misc_feature (623)..(623): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccggcccacgactggtgagtccttcggngacctgtccctcactgcgctgtctctggcgtccctcgatcgagtagttcgtttctcgtgggctgggtcgnagcctaccgagggagggngtaggtaatacatggaatcgtactctatataggtaggtacggttacttattaacgacgttccgtcgtctaccgaagtacggtacgtacgtacaccgtacttactctcgtacgtactacggtaccagactaatactaccgttttaccagtaacgtgtacgtacgttntacggtccgacccgtccgcgtacgtaccggtacgttacgtttancgtagtcgacgagacgagtctagttatagttagtttgtagttacgtattaccgactacgtagtacgcgggacgggtaccgtacccgaccgggtacggacggtaaggtaccgtttagccggttactacccgttccgtccggttaccncccctaaccgg

SEQ ID NO: 142823 - DNA, 732 bp, Homo sapiens
  misc_feature: GYAE6OF02HUDS9.46.67.G01.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
tcagactagcagtacacgaccggtgctcgatttagagtatacatattgggtttggggagtctcggtcaggacacagcatggacatgaggtccccgctcagctcctggggctcctgctactctggctccgaggtgccagatgtgacatcgagctgacccagtctccactcctccctgtctgaccaccggtgganacagtntaccaccatcacgttcggcccggganaacggtcggaactattacgacctaaccttaagttttaaagttggtactacaactaatacgaccgaacggggacccgacccctaagccttaccgtaatcttaagtcgacgttcgactaacttcccgttaggtttacgacgttaaacgggtccggtaccctagtcggtaggttcgacggtggacgtaggtgtacgtcgtagggtactaacgtagttaccacgtcctacactacgtacgtacgttaactcgtacgaaccgttacgtagtaagttatttacgaactttaacgtttattaaccggtattacaaacgttaacgtaaattacgttacgtttacgggtttaccggaaccgtaacgggtaacttaccgtaaaccgtaaacgttaaaacggtaaacgtaacgtcgggtacggtacctaacggtaccttaactacccgttgttacccggttacttacccggtttccttaaccccggttccctaactaccgttacccgagtttaaccgg

SEQ ID NO: 142824 - DNA, 879 bp, Homo sapiens
  misc_feature: GYAE6OF02FSXND.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttgtttcttctggggctgggtccggnagcctccgaggggaagggcctaggaactacgagttacggagttgtctactcgagtaggtggtacggttctaagttacagtccgtctctacaagtacgtcgagtccacgatactcgtcgtcggacctacgtccgagtactaacttacgttaccgttttcccgaggtaaacgtattacgtgttacgtcggtacgacccggtccgtacgtacggacggtaccggggtttacgtttttaacgttacggttcggttacggacgtaacggggtaacgtaccggggttactttaaacgttttaaggtttaaggtttttaggtttttagggggttaacggttttaggggttttaaccgttttaccggttaacccgttaacccggttaacggttaacgggttacccgggggtaccggggggttcccgttaaccccgggttaccccgggggtcgggggaacccggttaacgggggtaaactttaccgggttaccggtaacccgttacccggtttacccgttacccgttaccggtccccgtttaaccccgaacccgggtaaacccgggtccccgttaaccggttttaccccgggttacccccctttccccgggttaacccgggtacccccttaccccccgtttacccgtaacccggtaaacccggtcggtaaccccccgg

SEQ ID NO: 142825 - DNA, 672 bp, Homo sapiens
  misc_feature: GYAE6OF02IYDU3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtggagacagtgtcaccatctactcggccggacagtacgaactatagactacttaattaagttagtatacaacagtacgaccgaacgggaccggtacccgtaacgtcctacctaactactactcgtctcgacgtacgtaccgtagttacgtacgtaacggtcgggtaccgtacgtacggtacggtacgtaggtcggtacgtaggtacggtacgtacggtacggtaacgtacgttacgttactactacctacctaactactacgtaacgtaacgtacgtacgtaacgtaacgtagtaacgttacgttacgtacttaacttaacttacgttacgtaactaactaagtaacttaacgtaacgttacgttaccgtaacgtaacgtaacgtaacgtaactaaactaaacgtaaacgtaacgtacgtacgtacgtacgtactactacgtacgttacgttacttactactaccgtacctactactacgtacg

SEQ ID NO: 142826 - DNA, 691 bp, Homo sapiens
  misc_feature: GYAE6OF02ICHAE.46.67.G01.1.454.CMB.1.raw
  modified_base (326)..(326): a, c, t, g, unknown or other
  misc_feature (326)..(326): n is a, c, g, or t
tcagactagcagtacacgaccggtgctcgatttagagtatacatattggggtttgggggagtctcggtcagggacacagcatggacatgagggtcccccgctcagctcctgggggctcctgctactctggctccggaggtgccagatgtgacatcgagctgacccagtcctccactccctccctgtctgaccaaccggtgggagacagtcgtccaccatctacgttcggccgggacgaacggtacggaactagttacgacctaaccttaatttaagttaggtatacaatatacgaccgagggaccgaccctagctactaatctagngtctgacatacctgttacgacgtaagggttccgggtaccaggttacggtaggttacgacggtggacgtagggttagacgtggtacgggacttagtacgtttcgaccttctacctaacctactacgttaagttactcgtacgtacgtaaacgtacggtaagttagttacgtaacgttaaactttacttaactacgttaactaaacgtaattaaacttaagtaacgtttcggtttaccgggaaccgtacgtaaccgtaacgtaacttaaacgtaaaacgttaaacgacgttagtacgtactacgtaccgtactacttacgttacgttaccttccgtaccttcccgtaccgtacctacttctagttac

SEQ ID NO: 142827 - DNA, 910 bp, Homo sapiens
  misc_feature: GYAE6OF02IWWZX.46.67.G01.1.454.CMB.1.raw
  modified_base (483)..(483): a, c, t, g, unknown or other
  misc_feature (483)..(483): n is a, c, g, or t
tcagactagcagtacacgaccggtgctcgatttagagtatacatattgggtttggggagtctcggtcaggacacagcatggacatgagggtccccgctcagctcctggggctcctgctactcgtgcctcggaggtcgccagtagtgtcgactacgtcgagtcgtaccgaccctacgtccctacctaccttcccctcccgttcgttcgtcgaacccgtaaccgggtagggacgtaacgtacggttcgtacccaaccgtactaccgttacgttccgggacccgggacgtaaacgggtaaccggaaactacgttacgaaccttaaccgtttaaagttttaacggttagttaactaaccaaacgttaacgtaccgaaccggaacgggacccgtaacccgtaagtaccttacctaacttcgtagtcgctacgactacgtcgttagtacgtaacggtaacgggttccggtaccaggttcggtacggttnagggtcgacgtaggtacggtactcgggtaacggtacgtaacgttacttaacccgtcctaccgttacccgtaactacgtaacgttaaacgttaacttaccgtaccggtaaacgttaaggtaagttaaaccgttttagttaaccgtaaactttaaacgttttaccgttacgttaacgtaaacctaagttaaacgttaaacttaagtttaaccgggttttacggttaacccggtaaacgggtaaaccgtaacgttaacccgtaaaacgtttaaaaccgttaaaaacggttaaacccgttaaggtaccgtttacgaccgttaaccgtaaccgtaaccgtttacctttacgttacccgttttaaccgttacccgttacccggtttccccgtttaacccccgtaagtttaccgtttaccgtacctttaaacgg

SEQ ID NO: 142828 - DNA, 616 bp, Homo sapiens
  misc_feature: GYAE6OF02H2D9L.46.67.G01.1.454.CMB.1.raw
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtggggctgggtccgcagctcccgagggagggctggaatacattggaagtgtctctcatagtggaggttcctattacagtccgtctctcaagngtcgagtcaccatatcnctggacacgtccagcaatctagtttttccccagtaacgattgagtttctgtcgaccgccgctgactacggggcttttagttactgtgcgagagacggctattatgatttttggagttggtttatttcgaacacccgtaagacgtcggacggggctccgtaccccgtgggggcccaaggggaaatcgtacgggtccgacccgttcgttacccgtttagcccgtacccgaacccgaaacgggtaccccacggttcccggtccctttccccccgtcggaccctacccccttcctaccccaaggtccgtaacccg

SEQ ID NO: 142829 - DNA, 787 bp, Homo sapiens
  misc_feature: GYAE6OF02JR57M.46.67.G01.1.454.CMB.1.raw
  modified_base (366)..(366): a, c, t, g, unknown or other
  misc_feature (366)..(366): n is a, c, g, or t
tcagactagcagtacacgaccggtgctcgatttagagtatacatattgggtttgtcctcctgctggtgcagctcccagatggtcctgtccctggtgcaactgcaggagtcggacccacgactggtgacggccttcggacgccctgtccctcaccgtgcgctgtctcgtggtcgcctccatcgtagttcgtcgtttccgttcggtggggtcttcggggtaccgcgacgtccgtacccggaagggggaacggggtccttaaggaaacttcggtaagttggaacgttcgtcctcgttcaagttaggtcggtacggttccctaagttccagttccgtctcgtaacgaagtacgtcgacgtaccacgtatntctaccgtggacacgtccagctaacgtctagtttccagaactgttacacgttctggaccggacccgtagtctaggtaaccgtcgggttaacttttacgtcgtagtggaaccgtacggtacgtaacgttcgttaataagttcggtttaatttacggtaggttcggtttaaccttaccggaaccttaccggttagaaccggttaccgggggtaaccggtcccgttcgggaaacccccgggttacgggaccggtttaaacggggaccctttaacgggtttcggaaccccgttcggttccctaccggggttaacctcccctaacgggtacccggtaacccggttccttaacccggttccgggttccccctttacccggtacgaaccccccgttactttacccccggaatacccgggtctaacccc

SEQ ID NO: 142830 - DNA, 707 bp, Homo sapiens
  misc_feature: GYAE6OF02F00UK.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttggagaccctgtccctcacctgcgctgtctctggtgcctccatcagtagtggtttctcgtgggctgggtccgcagcctccgaggggaagggctggaatacagttggaatgtctctanagtagtggtaggttcctagttacacgtccgtactctacgaaggtagtcgagtccaccgatactcgtctcggacacgtccacgactaattcgtacgttttccgagtaagcgttagtacgttctcggtacgaccggccgtactacggacgtaccggtacgttttacttacgtcggtcgcgacggagtaccgtattacgtttagtgttaagttttggggtagttggttacgttacgtacctaccgtacgtacgtacgggccggggtacctacccgggtacccggtaggggaccgtaacgggtacgttacggtcgttaccgtaccgtttcccgtaccgttaccgtcccgtaacccgtaacccggaacgggtacccctacggttacccccggttacccgtttacccccggttacggtacccccgtaccccgttacccgtaccgtaaccgcgtaacccccgg

SEQ ID NO: 142831 - DNA, 667 bp, Homo sapiens
  misc_feature: GYAE6OF02HDDAU.46.67.G01.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgaactgacccagtctccatccctccctgtctgccaaccggtggganacagtgtcaccatcacttggccggnaagtcgaacntgacactattaatgatcaacatacgacgaggacgccctaagcctactaatctancgcgtncatccgtagtttacgacgtaacggtcggggtacccagtacggtacggttactacggtggctaggtaggaacgtggtacggactaggtactttacaccttactaccacctactacgtagtactcctacggaccgtaaggtacgtaacgttaatttacgaacttaacgttttaacgtacttacgttaaccaacgtaaagttaactttaactacgttttacgtttaaccgggacgtaaccggtactaacgtacctaaacgttaaacgttaaacgtacgtaggtaccgtacgtacgacctaccttcgttacgttaccgttccgttaacctacccgttaccccttacccgttaccgttacgttccgtagtacccttaaccgg

SEQ ID NO: 142832 - DNA, 767 bp, Homo sapiens
  misc_feature: GYAE6OF02GHTUT.46.67.G01.1.454.CMB.1.raw
  modified_base (181)..(181): a, c, t, g, unknown or other
  misc_feature (181)..(181): n is a, c, g, or t
  modified_base (222)..(222): a, c, t, g, unknown or other
  misc_feature (222)..(222): n is a, c, g, or t
tcagactagcagtacacgaccggtgctcgatttagagtatacataattgggtttgtcctcctgctaggtggccaggctcccagatgggtcctgtccctggtgcaactgcaggagttccggcctacgacgtggtcgaggccttcggacgaccctgtccctcacctgcgctgtctcgtggtcncctcatcagtagttcggttcctcgtcggggctggggtccgnacgtcctccgagggacgggtctaggaatacagttcggaagttcgtctactatacgtagtcggacgttccgtaagttacgacgtccggtcctcgtacaaggtcgtacgagtccaacgtattactcctcgtcggtacctacgttccacgtactaaactcgtaccgttttcccaggaacgtacgttgtaaccggttctaggtaccggtaccgccgttaacgcgggaacccgtacggggtttaccttttaacgtacgttacgtcgggtacggtaacgacgggtacggttacttaatttacggtaggtttagttttcggtaacggtttcgggtttaacttaccggtaacctacccggttagtaaccgtcggggtacccgggtcgttaccggacccggtcggggaccgtaacgggtaaccttacggtaccgtccgtaaccgttccgtcgttaacccgccgttacgacccgtaacggtccgtaacggttcccggttacccttaccccggcgtacccgttacccgacccgttaccgaacgttccgtaacccgg

SEQ ID NO: 142833 - DNA, 623 bp, Homo sapiens
  misc_feature: GYAE6OF02FSBR7.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtntcaccatcacttgccgggacagtcggacattgacacctatttaattggtatacaacatacgacagggaccgcccctagctacctattctatgctgcactcctagtttagacgtaaacggtcgggtacccagttacggaggtttacgaggtcggacgtaggtgtacgttcgtgggactaggtactttcaccttctaccgtacctagtaacagttactcgtacgacgtacgtagttaagttcgttactaaccttaattacttacgtacgtaactaaacgtaattaacttaacgttacgtttcgggtaaccggaaacgtacggtaaacaacgtaactaaacgtaaacgtaacgtagtacgtacgctacgtacgtacttacgtcgttcgttactcttaccgttcccgtacctacgtctactcgtaacg

SEQ ID NO: 142834 - DNA, 1056 bp, Homo sapiens
  misc_feature: GYAE6OF02IP499.46.67.G01.1.454.CMB.1.raw
  modified_base (236)..(236): a, c, t, g, unknown or other
  misc_feature (236)..(236): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccggcccacgactggtgaggtccctttcggacgacccctggtacccctctacccgttgccgtccgttggttcctcgttgggttcncccccttaccattcgtaaggtttcggtttcggtttttccgtttcgggtagggggtccgttcggggggttccccggacgtacggtcccgttcccgggaacgggggaacgggggtccggtagggtaaacgttaacgtaacgtttacggggaagtttcggtaccgttccgttaccgtaggttagggtacgggttacgttttacccgttaagttttaacgtaccggttcccgtttaccgtttaccgtacgtaacggttacggttaccgtaccgttacgaacctaacgtttacttaccgttcgtacgggaaccctaaccggttaccgacggtaaacctaaacgtttacctttaaccggtttttccccgtaaggtaaagttacgttacggtttaaccgttttcggttaccggttaccgaccccccgggtacgtaccggttacggttaaaccgggtttaccgggtttaacccgttttttaggttaaacccgtttcgggttaccggtaccgggtaaggtaaccggggtacccggtttaacgtttaagggtttttaaacggtttggtttttaaaccgggtttttttttggggtaaaacggggtttttcgttttttaaaccggtttaccggtaaccccgttaaaccggttaaacggtttaccgggttacccggggttacccgggggtaccccggttttaccccgggtaaccccgggggtttccggtaacccgggtttaaaccggggttaaaccggttaccggtttaccgggtaccccggttaccgtttaccccggtttcccggtttacccgtaccccgtttaacccccgg

SEQ ID NO: 142835 - DNA, 666 bp, Homo sapiens
  misc_feature: GYAE6OF02FV2OS.46.67.G01.1.454.CMB.1.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacgattggaagttgtctctcagtagtggagttccctagttacaggtcccgttctctcgaagngttcgagtcaccaatntctctgccagttccagccaatctagttttcccngaatatgacgtttcngtcgaccgccgtntcggactcgggttacttttaataccgtggtgaccggaggtacgacggtcttaagttacttcgttagtttttagggaggtttaggtttacgttttacgaaccttacccgttaagacgtcgggtaacggggtccttacccggacccggtacggggcccgaaggggtaacgttacgttcgggtcctaccggttccgttaccgttaccgtaccgttacccgaaccggaacggtacccgtacgtccggttccccgttccccgttcggccctacccgttccacctaacgccgtacccg

SEQ ID NO: 142836 - DNA, 807 bp, Homo sapiens
  misc_feature: GYAE6OF02FITY3.46.67.G01.1.454.CMB.1.raw
tcagactagcagtacacgaccggtgctcgatttagagtatacatattgggtttggggagtctcggtcagggacacagcatggacatgagggtccccgctcagctcctggggctcctgctactctggctccgaggtgccagatgtgacatcgagctgacccagtcctccatccctcctgtctgcaaccgtgggagacagtgtccaccatccacttcggcccgggactaaacggtccggaacctatttcggacctaacccttaagttttaaaacttgggttaatcgaaacattacgaccgagggaaccggcccctaagcctacctaacgtctatgctgctactcgtagtttagacgtaaacggtcgggtacccagtccgtaggttcaacggttggcgtaaggtggtactcggtagggacgtaacgtaacttccgtaactccttccaaccgtactcgaacggtttaactcgtagtcccgtaaacggttaacggtaaacgttaacgtttttacggaaccctttaaacggttttaacctttaacgttcccggtaacttaaaaccgtaaaggttaaaccttttaaacctttaaaacggtttaccggttttttaaccgggaacccggtaaaaccggggtaaacccgttaaacggtaaaccttaaaccaaaaaacggtttaaaaccggtaaacgtttacggtaacgggttccctaacggtaacccgtaaccgttaacttaacccggttcgtttaacccttaccgtaacttccccgttaacccccggtattaacccggttacccgttaggttaacc

SEQ ID NO: 142837 - DNA, 713 bp, Homo sapiens
  misc_feature: GYAE6OF02IT78C.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactcgtggcctcggaggtgccagatgtgaacatcgagcctcgacccagtcctccactccctcccctgtcctcgaccaaccggtggagactaggtcgtaccaccgtatacctacgttggcccgggtactaaacgggtaccggtaactagttcgaacctaaccgtttaatttaaacgttagtaacttacaactataccggacccgaacggggacccgaccccgtaagtaccttaccgttaaatcgtaagtcgtacgtacgtaccgattcccgttagttacgaaccgtaacggtccgggtaccctaggtcgtacggtgaggtgcgtaggtgtacgtcgtaggactagtacttcactcctacacctatacgtagtactcgtacgtacgtaacgtataacgttgttaacgtaccttagttacgtacttcgtaaccgtaagtaattaacttatacgtttcgttaacggaacgtaggtaaccaacgtaacttaaaccgtaaagttaacgtaaacgtcggtacgtacgtacgactaaccgttacttcgttaccttacttaccgttaccgttcccgtacccttacgtactacgtaggtaaccc

SEQ ID NO: 142838 - DNA, 637 bp, Homo sapiens
  misc_feature: GYAE6OF02FMJ0H.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatccctccctgtctgacgaaccgtgggacgacagtgtacaccatcacgttcggccggtcaagtcgaacattcgactacctaatttaaattggtaatacaacatacgaccgagggaccgtacccctaagcctactaatcagtcgctgctactctagtttgacgtaacggtcgggtccaagtcggtagtttcaggtcgacgtagtggcgtcgtaggactagtatttcgacttctacactactacgtagtacgtctacgactaacgtagtaagttatttcgaacttaacttacgttacgttcgtaactaacgtaagttaaacttacttaacggtttcgttaccggaacgaacgggtactaaccggtaactaaacgttaaaactacggtaactggtacgtactagtaccacgttacctacgttcgtaccgtttacgaccttacccgtaccccgtatactttccgaggttaccg

SEQ ID NO: 142839 - DNA, 662 bp, Homo sapiens
  misc_feature: GYAE6OF02GS27M.46.67.G01.1.454.CMB.1.raw
  modified_base (213)..(213): a, c, t, g, unknown or other
  misc_feature (213)..(213): n is a, c, g, or t
  modified_base (324)..(324): a, c, t, g, unknown or other
  misc_feature (324)..(324): n is a, c, g, or t
  modified_base (659)..(659): a, c, t, g, unknown or other
  misc_feature (659)..(659): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctggggtccggnagctccgaggggaaggggctggaatacagttggaagtcgtctctcagtaggtggtagttacctattacgacgtccgtctctacaagtacgtcgagtacaccatactctcgnggacacgtccagacatcgtacgtttccagaagatgtagttcgtagtcgaccggccgacgtgaacggtacgggtttcttttattacgttggtacgcggaggtaacgacggtattaacgttagttgtttaggtttttgggtaggtttacggtttactttacgaaccgttaccgttacggtaacggtccgggtaccgggggtccgtcccggtacccgggtacgggacccggaaggtaacgttacgtcgttaccgtaccttcgttcctacggtccctccgaccgacggtacctaccgttccgttcccttcccgcgtccctaccctccgtaccagtaccnccg

SEQ ID NO: 142840 - DNA, 746 bp, Homo sapiens
  misc_feature: GYAE6OF02ISGDX.46.67.G01.1.454.CMB.1.raw
  modified_base (218)..(218): a, c, t, g, unknown or other
  misc_feature (218)..(218): n is a, c, g, or t
  modified_base (258)..(258): a, c, t, g, unknown or other
  misc_feature (258)..(258): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccggcccacgactggtgacggtccttcggacgaccctgtcccctcactcgcgtctgtctcgtggtcncctcatcagttgttcgtttctcgtgggcgttcggtccgcncgtcctccggaggggaacggtctagaactagagttggagtcgtactctcagtacggtggtacgtttacctagttacgacggttccgtcttcgtagtaaacggtcgttaccgtacgtactaaccgtattaacgttccgtcgtaacggaccctaaccgtaccgtaacgtaccttaaacgttcccgtttaccgttttacccgaaaggtaacgtacgtttcggttacggttttcgtacggtaccgacccggtcgtacgtacgtacgggtaccgtttaccgttttagtcgtaggttcgagtacggaggtacctctagtttacgtgtttacgggtttgtacgttttgttacgtacctaccgttaccgtaagtacgggtaccgggtacgggttccccgtcccgggtaacccggttaccgggaccggttaagtacccgtttagggtccgtacccgttacccggtacccggtttcccttaccggccccgtaacccgg

SEQ ID NO: 142841 - DNA, 720 bp, Homo sapiens
  misc_feature: GYAE6OF02GKW01.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtcccctcacctgccgtctgtctcgtggtcgccctccatcagttaggttggtttcttcgtggggctgggtccggcagccgtcccgaggggacggggctaggaactacgtagttaggaagttcgtctctcataggtaggtacggttcctattacgacgttccgtctcgtacaagtagtcgactcactatactctcgtacgacctacgtcgagtactaactcgttacgttttcccgaagaacgtatacggtacgtttcgtcggtacggcccgtccgtcgtacggtaaccgtacgggtttacgttttaacttcgtggtacggtacgtacggtaacggacgttactttaagtttagttgtttaaggtttttgggtaggttttcgtttaactttaccgaccgttaacccgttaaggtaccgtaccgggggtacgggtccgtaccccgggtacccgggtacggggaacccgtaaggggtaaccttacgggttccggtacccgtacccgttccgttaccgttacccggaccctaaccccgg

SEQ ID NO: 142842 - DNA, 777 bp, Homo sapiens
  misc_feature: GYAE6OF02FKLKC.46.67.G01.1.454.CMB.1.raw
tcagactagcagtacacgaccggtgctcgatttagagtatacatattgggtttgggggagtctcggtcaggacacagcatggacatgacgggtcccgctcagctcctggggctcctgctactctggctccgaggtgccagatgtgacatcgagctcgacccagtcctcatcctccctgtctacgcaccggtggacgacagtcgtacaccatcctacgttcggccggtacaagtacggaactagttcgacctaccttaatttaaagtggtactcaacagtacgaccgagggtaccgtacccctaagcctaccgtaagtccttagtcgcctaggcctaacgttcccgtagtttcggacgtaaacggtccggggtcccctagtccggtaggtttccgaggttcggacgtaggtcgggattcggagggtacagttacgttacacgttcctacctaccgacgtcgtaacttaaacgtccgtacgtaaccgtaacgttaggtaaccgttgttttaactaccgtttaaacttacgtttaacgttcgtaaaccgaacgttaacggttaaactttaacgttaacgttttccgggtttaaccgaaccgggttaaacgggtaccttaaaccggttaacgtaaaaccgttaaacggttaaaacggttaaccgttaggtaccggtacgttaccgaaccggttaaacctcggttttaacctaccggttttacctaccgttaccgtttacccggttcccttaaccgtttcttacccggttaccgtaacccgg

SEQ ID NO: 142843 - DNA, 754 bp, Homo sapiens
  misc_feature: GYAE6OF02GH3ZW.46.67.G01.1.454.CMB.1.raw
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (322)..(322): a, c, t, g, unknown or other
  misc_feature (322)..(322): n is a, c, g, or t
  modified_base (397)..(397): a, c, t, g, unknown or other
  misc_feature (397)..(397): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctntcngacaaccggtggagacagttgtccacactctacgttcgccgggacaacggtacggaactagttcgacctaaccttaatttaattgtactacaacatacgaccgaacgggaccgtacccctaagctaccttaatctagtcncgtgacctacgtcttagtttacgaacgtaacggtcgggtacctagtcggtaggttacgaggtcggactaggtcgngttcggaaggacagttacttacgacttctacctactacgtacttagtacgtcgtcgtaacgtaacgttagtaacgttacgttactaacttaacgttaacgtttacttacgtaactaacgttaacgttaaacttaacgttacgtttacgggttttaccggaaaccggttaaccgggtaaacctaaaccgttaaccgttaaaaaccgttaaaaccggtttaaaacccgttaaacgggttcggtacggtttacccgagttaaccccgttaacgtaacctttaccgtttaccgtttaacccttttacccggttacgttacccccgtttacccggacctttacccgttacgttacttaaccg

SEQ ID NO: 142844 - DNA, 716 bp, Homo sapiens
  misc_feature: GYAE6OF02FSLLK.46.67.G01.1.454.CMB.1.raw
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtgggggtctggggtcccggcaggcctcccgaggggaggggctggaatacattggaagttcgtctctcataggtgggaggttcctattacagtccgtctctcaagngtcggatcaccaatatctctggaacaccgtcagctaaatctacgttttcccngaagtatggacgttctggtacgaccggcccgcttggaccgtaacggggttcttttaacgttagtggtcgcgtaaggtacggacgggtctaagtttacgttagttagtttttaggggtaggtttaggtttacgttttaccggaaccctaccccgttaggtaacgtccgggtacgggggtcctcccgggaccccgtgggggtacctaaggggtaacttacgttcggtacctaccggttccttaccgttaccgtacccgtaccccgtaacccgtaaccgggacccctaccggttcccggttaccccgtttccccccgtcgggtaccccctacccccgttcccgtacccgaaggtacccgaacccgg

SEQ ID NO: 142845 - DNA, 578 bp, Homo sapiens
  misc_feature: GYAE6OF02IE3KT.46.67.G01.1.454.CMB.1.raw
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccggaggtgccagatgtgacatcgagctgacccagtctccatcctccctgtctgcaaccggtgggagacagtgtcaccatcattcggccgggcaagtcggaacattgacacttattaaatgtatcaanatagacgagggacggaccctaagctacctaatctaangctgccatccgtagtttcacgtaaaggtcgggtaccagtcgaggttcaggtggacagtggatcgtagggactagtacttcgactctacactatcagtaatctacgactaacgtagtaatactttgaactaattattactagtacaaagtataaattactaattgtttacggacgaaggactaacggaactaaactaaaataaaccgaagttcgtaggtactacgactaaccgtacttctagtttaccttcgtacttccgtacccgtactactacctaggtaacc

SEQ ID NO: 142846 - DNA, 758 bp, Homo sapiens
  misc_feature: GYAE6OF02F8B79.46.67.G01.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtccctnacctgcgctgtctctggtcncctccatcagttagttgtttctcgtggggctcggggtccgnagcctaccgaggggagggctaggaatacgagttaggaagtgtctctcgtagtaggtgggtacgttcctaattacgtacgttccggttctaccgtacgaaggtcgtacgtacgtaccaacctattacgttctcgtacggtactaccgtccaagactaacttccgttacgttttacccaggtaagtacgtaggttactttcgtacggtacggacccgtcccggtacgtacgtaaccgggttaccgggtttacgttttacgtaccgttaggtcggtacggtacgggtaaggtaccgttacgttttaagttacggtttaacgtttaggttttttagggacggtttttacggttttacgtttaccgtaacccgtaacccgttaaggtacggtccggggaccgggttaccgtacccggtaacccggggtccggaaccggtaacgggttaactccggttccggttaacccgtcccgttacgttaccccgttaccgtaccccgtaaccccgg

SEQ ID NO: 142847 - DNA, 800 bp, Homo sapiens
  misc_feature: GYAE6OF02ITOHN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgactatcgagctgacccagttcctccactcctccctgtctacgaccgtaaccggtgggacacgtgtcgtaccaccgtactctaacgtcggtaccgggactaacggtacggtaaactagttacaaccgtaaccgtttaattttaaacgttacggttaataaccgaaactagttaaaccggaaccgacggggtacccgaccccgttaaagtaccttaacccgtaattccttaacgtcgtccttaggacctacttaccgttagtttacggaacggtaaacgggttccgggtaaccctagttccggttaacggtcgtacgggtaggtctacggggttacacggttcggtaacggtaactacggttaacttcctacgtactaacctaccgtagtaacctaacgtactacgtaacgtacgtacggttaagtagtttaactttacgactttaaacgtttacttacgtaccgttaaacgtaacttaacgttaaacttaacgtaacgttttcgtttaacccgggacggtaaacggtaacctaaccggtaacttaaacggtaaacccttaaaagaccgttaacgttcgtaccgtctaccgtaacctagtaccttacggttctaaccgttaccgtttccctacccgagttaacctacgtacgttaccg

SEQ ID NO: 142848 - DNA, 738 bp, Homo sapiens
  misc_feature: GYAE6OF02JD4EA.46.67.G01.1.454.CMB.1.raw
  modified_base (436)..(436): a, c, t, g, unknown or other
  misc_feature (436)..(436): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcaaccggtgggaagacagtgtcaccatcacttgccgggcaagtcgaacattgacaccttatttaaattcggtattcaactatacgaaccgagggaacccggtcccctaagtcctaccgttaatcttaagtcgtaccttgacctacttcccttaggtttcgaacgtaaacgggttcggggttaccccaagtccggtaggtttccgaggtcggactaggtcgtattccgtagggactaaggttatttcccacgttccncaaccctagtacgtaagttaacttcgtacgtaacgacgtttaacggaatttcgtttacgaactttaaattacgtttaccgttaggtaacctaaactaaacgtttaaacttacgttaaacgttttcggtttaaccggacccgtaaacggggtacctaaaggaacctttaaacgtaaaacgtttaaaacgtacgttaacggggtcgtacctaacgtccgtaaacccttacggttccttacgtttaaccgttaccttacccgttacccgttaccccgtacctaacggtttacctagttaaacccg

SEQ ID NO: 142849 - DNA, 534 bp, Homo sapiens
  misc_feature: GYAE6OF02FVNLH.46.67.G01.1.454.CMB.1.raw
  modified_base (192)..(192): a, c, t, g, unknown or other
  misc_feature (192)..(192): n is a, c, g, or t
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcattgccgggcaagtcggaacattgacacctatttaatggtatcaacatagacagggacgcccctaagctcctaatctatgctgcatccagttnacaagtgggtccagtcgagttcagtggcaggtgatcgngggatagatttcactctacacatcagtaatctagacagtgaatntttacgactaattnttactntacaactagtaattactaagttcgtttcggacgtaagggactaacgtactaaactaaacgttaaacgaacttcgtaggtctacgctaacctataccttgtacttactcttccttacccgactacttctgtaac

SEQ ID NO: 142850 - DNA, 562 bp, Homo sapiens
  misc_feature: GYAE6OF02F9JJG.46.67.G01.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtcncctccatcagtagtgtttctcnggggctgggtccgnagctccgagggaagggctggaatacattggaagtgtctctcatagtggaggttcctattacagtccgtctctcaagagtcgagtcacatatctctgacacgtccagcaatcagttttcccngaantgagttctgtcgaccgccgctcgacgacgggtctttatactgtcgcgagagacgtactagttatgtagttttggagttgttagtttcgaacctacccgtagacttacggacggggtctaccggtacccgtgggggaccaacggggtaatacgtaggtccacccgttctcccgtttacgccctaaccccgg

SEQ ID NO: 142851 - DNA, 632 bp, Homo sapiens
  misc_feature: GYAE6OF02JG9ZE.46.67.G01.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
  modified_base (461)..(461): a, c, t, g, unknown or other
  misc_feature (461)..(461): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (562)..(562): a, c, t, g, unknown or other
  misc_feature (562)..(562): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggacgtcgggcccacgactggtgacggtccttcggacgaccctggtccctnaccgtgcgcgtgtcctcgtaggtcgccctcatcgagttacgttggtttcctcggtgggctgggtcccgangcctccgaaggggacggtcgtaggaatacgagttggaacgtntcctntacgaagtggtacggagttacctattacgcgttaccgtntcgttacaaaggtcgtgacgtcccaacgtaagttnccctgacgtaacctaacggtccaagccttaaatcctttaacgtttcccgaagtaaggattggtaacccgtttntcggtacgtccgcctgtacgtacgtcggtntttaaacngngttcgnaccggatcggtactagtagtggtttatacgggtattcgtaattcgaacttaccgngtagtcggacggctccggtcgcgggacaacgttacgcggttacgccctgtaacccgttctacgcctaccg

SEQ ID NO: 142852 - DNA, 656 bp, Homo sapiens
  misc_feature: GYAE6OF02HCN7J.46.67.G01.1.454.CMB.1.raw
  modified_base (172)..(172): a, c, t, g, unknown or other
  misc_feature (172)..(172): n is a, c, g, or t
  modified_base (194)..(194): a, c, t, g, unknown or other
  misc_feature (194)..(194): n is a, c, g, or t
  modified_base (206)..(207): a, c, t, g, unknown or other
  misc_feature (206)..(207): n is a, c, g, or t
  modified_base (210)..(210): a, c, t, g, unknown or other
  misc_feature (210)..(210): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtncctcatcagtagtgtttctcgngggctgggccgnngcnccgagggagggctggaatacattggaagttgtctctcagtagtggtggttcctattacagtccgtctctcgaagngtcgagtcaacntatctcgnggacacgtccagcaatcgtattttcccgagaagtatagtagttctgtcggaccgccgctcgacgacgggttctttagttacgtggtgacgtagcggacggtacttattcgttagttacgttttgggagtttacggtttacttcgaccttaccgtacgtagtccggggtacgggtccgtaccgacccggttcgggggacctaaggggtaaccttacggtacgttaccgacccgttcgttacccgtacgtccccttaccgaacccggtaccgggtccctaccggttaccggttccccgttcccccggtacggcccctacccccgtcccgttaacccgaacggtcgtaccccgg

SEQ ID NO: 142853 - DNA, 787 bp, Homo sapiens
  misc_feature: GYAE6OF02HDY7T.46.67.G01.1.454.CMB.1.raw
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctntctgcaaccgtggganacgagtgtacaccatcgaccttggcccgggactaacggtacggaaactagttacggaacctaaaccctttaagttttaaaattggttaatacaaacagttaacgaacccggagggtacccggacccccttaaggccttaccttaaactcttaatggctgactaactccgtaagtttcaacggtaacgggttccgggtacctaacgttccggtaagggttacctagggtcgggacgtagggtcggtaacgtcggtacgggactaagggttactttaccgaactcctaccaccgtacgttacgtaactaactacgtacgaaccgtaaacggttacgtaaagtttagtttaacgaccgtttaaagttttaacttaaccggttacggtaaacctaaacgtaaacgttaaacttttaaacgtaaacgttttacgggttttaacccggaaccggttaaacgggtaaaccctaaccggttaaacctaaacgttaaaacgtaaacgtaacgttacggtacgtacgtacgtacccgtaacttacgttacgttcttaacttacgttaccttacccgttcccaccgttacgttactacgttaaccg

SEQ ID NO: 142854 - DNA, 905 bp, Homo sapiens
  misc_feature: GYAE6OF02JW665.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggcctcgaggtgccagatgtgacatcgagctcgaccagtctccatcctcctgtctgcgaaccggtgggacgacagttcgtaccacctatcgacgttcgggccgggactaacggtacggaactacgtttacgaacctaccttaaagttttaaagttcggttaacttaccaaactaacgtaaggaacccggacggggaccccggtacccccgtaaacggtaccttaacccgttaacgttaccttaactcgggtccttcggacctaccgttacccgtaggttttaccggaaccgtaaacgggggttacccgggggttaaccctaacggttccggggttaacggggtttacccgtaaggggtggtaacccggtagggttaacgggttacgttaccggggttacggggtaaaacgtacggtttaaccttttacccgtaacctttcccgtacccgtaaaccttacgttaacgtaacgtttaacgttccgtacggtaccaaaaccggggtttgttaaacggttaacttttacggtaacttaaactttttacttaaccgtttacgtaaaccgttaaccgttaaagttaaacgttttaagtacggtttttaaacccggtttccgggtaaaccggaaaccggttacctaaaacccggttaaccttaaaacgttaaaaccgtttaaaacggacccggtttagtaccggtacgttccgtaacccggtactttaccgttacttcggttaccctttaacgtcctttcccgtccgtacgtacttacccgttgttaac

SEQ ID NO: 142855 - DNA, 605 bp, Homo sapiens
  misc_feature: GYAE6OF02GY81G.46.67.G01.1.454.CMB.1.raw
  modified_base (344)..(344): a, c, t, g, unknown or other
  misc_feature (344)..(344): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctcatcagtagtgtttcttcgtgggctgggtccgcagcctccgagggagggctaggaatacgagttggaagttgtctctcgagttaggtggtaggtttcctaatttacgagtcccgtctctacaagagtcgagtccacatatctcgtgacaccgtcagcatctgttttccngtaagatgagttcgtgtgaccgcgcgtcgacgacgggtnttttatacgtgtgacgagacgacggtcttaattagtgttagttttgggatttaggttatttccgacctaccgttagacgtcgggaacggggtcctcccgacccggtgggaccgagggtaactacgtcgtcctaccgtacttcctacgtccctaccgacccgacggtcccagttcccggttcccttccccgtcgccctaccccttccacccgtacgctacccg

SEQ ID NO: 142856 - DNA, 896 bp, Homo sapiens
  misc_feature: GYAE6OF02IAYNN.46.67.G01.1.454.CMB.1.raw
  modified_base (480)..(480): a, c, t, g, unknown or other
  misc_feature (480)..(480): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccgttcggacgaccctgtccctcaccgtgcgctgtctcgtggtcgcctcatcgaagttggttgtttcttcgtggggtcgtcggggtccggcaggccgtcccggaaggggtacggggtctaggaaacttacgtagttagggaacgttcggttacctcgttacgaaggttaggtacggttaaccggtttactttaacgttaccgtacggttccccgttatctaacgtaaaggtcggtacgtaacgtacccaaccgtaattacgttccgtacgtacggaaccctacggcaagtctaagtccttaccgtttaccgagtaagtgtacggttacgttctacgggaccggtacccncggtcgtacggtacggttaacggtttacttttaacgttcgtaggtcggtaaccgaggtacggacgttacgtttaagttagtttaggtttaggttttagggtaacggttttaggttttaccgttaaccgtaaccgtttaccggtaaacggtaccgggttaaccgggaccggggtacccggttacccgggttaaccccgggtaggggaacccggtttaaggggtaacctcccgggtttacccggtaaccttcccggtttaacccgttacccggttacctacccccgtaaccggtaaccccgggtaacccgggttacccgttacccgtcccccgggtttttaaccccgtccccggttaccccgttccccggtaaacccccttcccggtttaacgacccgggtacccccgttaacccggg

SEQ ID NO: 142857 - DNA, 715 bp, Homo sapiens
  misc_feature: GYAE6OF02IV82J.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgacaaccggtggganacagtgtaccaccatccacttggccggacaagtcggaacagttcgacctaccttaatttaattggtactacaactagtacgaccgaacgggaccggaccccctaagcctaccgtaatctatgtctgctacgtcctagtttcgacgtaacggtcgggtacccagtcgtaggttacacgtggacgtaggtggtactcggtaggacgtagtactttccacttccgtacacctacgtacgtaacgttactacgtacggtaacgtaacggttagtaacggtttatttacgtaacctttaacgtttaacgttactaacgttaactaaacgttacgttaaaagtttacctaaggtttcgtttaaccgggaacccgttaagggaacctacgttaaacctaaaaccgttaaaacgttaaaccgtaaacgttcgggttaacgttaccgtaacgtaccgtaaccttaacgttacgtttacttaccctttacgtaccctttaccggttcccctacgttactacgtacggttaacc

SEQ ID NO: 142858 - DNA, 836 bp, Homo sapiens
  misc_feature: GYAE6OF02FMG0U.46.67.G01.1.454.CMB.1.raw
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggcctttcgggagaccctggtccctcacctgcgctgtctctggtcncctccatcagtagtggtttctcgnggggctgggtccgnacgctccgagggagggctggaatactattggaagtgtctctcagtagtggtacggttacctattacgacgttccgtctctcaaggtcgtcgagtccactatactctcgtacggactaccgtaccagtacctaacgttccgttaacgttttaccccgtaggaaacgtacgtttacggttaacgtttccgttacgggtaccggtacccggtacccggtaccgttaccgggtaaaccgggtaaccgggggtttccgtttttaaaccggtttaaccgttgggttacgggtaccggaacgggtaacgggtaaaccgggttaccgtttaaggttttaacggttggttttaacggttttttacggggtaaggtttttacgggttttaacttttaccggtaacccgttaaccccgtttaagggtaacccggtttaccggggtacccggggggttaccttaccccggggtaacccccgggttaccgggggtaacccggtaacggggttaacgttaccggtttacccgggtacccggtttaccccggtttaccgttaccccggtttacccggtacccccgttaaaccccggg

SEQ ID NO: 142859 - DNA, 758 bp, Homo sapiens
  misc_feature: GYAE6OF02JVQID.46.67.G01.1.454.CMB.1.raw
  modified_base (176)..(176): a, c, t, g, unknown or other
  misc_feature (176)..(176): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtcgccagatgtgactatcgagctcgacccagtcctccatccnccctgtctgcaaccggtggganacngtcgtaccaccgatcacgttcggcccgggactaaggtccggaaactcgttacggaacctaccgtttaattttaaaacgttcgggtaactaccgtaaactacgttacggaccgagggtacccgaccccgtaagaccttacctaaactcctaagccgccgtanacctacttccgtaggtttacgacgtaaacgggttcgggtaccctaagtccggtacggttaccacgggttcggtacgtagggttcggtaactccggttacggggtactacggttactttaccgaacttccgtaccaccgtatccgtaacgtaactccgtacgaccgttaacggtaacgtacgttacgtttacgaccttaacgtttaactacgttacgtactaacgaagttaactttaactacggtttggttaccggtaacgtaacgggtaccaacgttaaccttaaaccgtaaaattaacccgaaggtttcgtacggtctacgtaccgtaaccgttagtaccgttatttacccgctttacccgtacctaccccgttagaccttaccgtacgtaaccg

SEQ ID NO: 142860 - DNA, 647 bp, Homo sapiens
  misc_feature: GYAE6OF02GD2RZ.46.67.G01.1.454.CMB.1.raw
  modified_base (248)..(248): a, c, t, g, unknown or other
  misc_feature (248)..(248): n is a, c, g, or t
  modified_base (317)..(317): a, c, t, g, unknown or other
  misc_feature (317)..(317): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtggggctgggtccgnagcctccgagggagggctggaatacagttggaagtgtctctacagttaggtggacggttcctattacgngttcccgttactctacaagtgtaccgagtccacctattactctctcggactacgtccagactaatcttacgttttcccagagatgtagttctgtcgccgcgcgtcgacgacgggttctttagttacgtggtcgagagacggtacgctttaagttagttgtttagtttttacgggagtttaggttttacgtttaccgtaccttacccgttaagtacggttccgggtacgggggtccttcccgggaaccccggttacgggggacccggtaacggggtaacttaccggttcggtaccgtaccgttccgtacccgtttaccgcccgtaaccccg

SEQ ID NO: 142861 - DNA, 831 bp, Homo sapiens
  misc_feature: GYAE6OF02JXWQZ.46.67.G01.1.454.CMB.1.raw
tcagactagcagtacacgaccggtgctcgatttagagtatacatattgggtttggggtagtctcggtcaggacacagcatggacatgagggtccccgctcagctccgtggggctcctgctactctggctccgaggtgccagatgtgacatcgagctgacccagtctccatcctccctgtactgaccaaccggttgggacgactacggtcgtcaccctactcactttcggacccgggtacaaacggttccgggaaactaagttcggaacctaaccgttaagttttaaaagtttcggtaatactaaccgtaacgttaacgaaccgtacggggaaccggacccccgtaaacggcccgttacctaaacttacttaaacgttcgaccttcggactaccgtacctaacgtttcgtaccggtaaaacggtcgggggttaccccaagttaccgtaacgggttcgaacggttcggtaacctcggttaagggtacgttacggtacggggtacgtaaccggttaaaggtttcctaacccgtttactaccgtacccgtaacttacgtaacggttaaactccggtaacggtacctaaacccgggttaagtaaacgttacgttttactaccggttaactttacgttaacgttacgtactaacgtaacttaacgttataacgttacgttacgtacgtaacggactaaccggtaacttaaccaaacgttaaacaaccgttaacgtagtaccgttaaccgtaccggtaacctaacgttaccgttaacggttcctttaacgtaccgtttacctttcccggtacccttaacggttccctaagtttaaccc

SEQ ID NO: 142862 - DNA, 610 bp, Homo sapiens
  misc_feature: GYAE6OF02FRYIJ.46.67.G01.1.454.CMB.1.raw
  modified_base (337)..(337): a, c, t, g, unknown or other
  misc_feature (337)..(337): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccggcccctaagctcctaatctatgctgcatccagtttcgacaaaggtcggggtcccagtcggaggtttnaggtggcagtgggatcgtgggacagtatttacactctcaccatcagtaatctagcaacgtgaaagttnttttcgacttaacttacttacgttcgtacaactagaatttacgtaatttacggttttaccggaaccgtaacgggtactaacgtaacttaaaccgtaaaagttaaaaccgtaacttaggttacggactacggtacctaacctacttaccgttacgttaccgttttcaaccgtttcccttccccgtacctacttccgttagttaccc

SEQ ID NO: 142863 - DNA, 760 bp, Homo sapiens
  misc_feature: GYAE6OF02HW7XN.46.67.G01.1.454.CMB.1.raw
  modified_base (127)..(127): a, c, t, g, unknown or other
  misc_feature (127)..(127): n is a, c, g, or t
  modified_base (152)..(152): a, c, t, g, unknown or other
  misc_feature (152)..(152): n is a, c, g, or t
  modified_base (223)..(223): a, c, t, g, unknown or other
  misc_feature (223)..(223): n is a, c, g, or t
  modified_base (474)..(474): a, c, t, g, unknown or other
  misc_feature (474)..(474): n is a, c, g, or t
tcagactagcagtacacgaccggtgctcgatttagagtatacatattgggtttgtcctcctgctggtggcagctcccagatgggtcctgtccctggtgcaactgcaggagtcgggccacgactggtnaggccttcggagaccctgtccctanaccgtcgcgctagtctctaggtcacctccaatcaggtagttcggtttctcgtggggcttacgggtccgganacgcctacccgaaggggtaacggtctaggaacttacgagttcggaaagtcgtactacgtactaagtcggtaggtacggttacctaacgttacgacggttaccgtctacctcgaaaacggtacgtacgtaacggtactaccctaagtacgttactacgtagggtaacctaccggtccaagtacgaaacgttacgtacgttttaccccgtaagaacgttaagtacgtactcgttacggtcgtaccggtaccgntaacggacgtacggtacgtttaataccgtagtcgtacgaacggtacgtaaccggtacgtttaattaacggttagttaagttttacggtagttacgtttaacgttcgtaacgaccgttaagtacggtacgacggggtctaccgtccggtacggaccgtaaggtaacgtacgtaagtcccgtacgtccgttaccgttacgtacccgtacgaccggtaacggtcccttaagtccggtaacccgttccgtaccgaccgtacccgtaccctaacggtacgacttaacccgg

SEQ ID NO: 142864 - DNA, 777 bp, Homo sapiens
  misc_feature: GYAE6OF02JGZ82.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtcctccactcctccctgtctgacaaccggtgggagacagtcgtcaccatcacgtttcggcccgggtactaaggtccggaaactagtttcggaacccttaaaccttaaatttttaaaaacgttcgggttaaacttaccaaaaaccgtattaacggaacccgtaacgggggaacccggtacccccttaaaggtccctaacccgttaaatccgttaatcggacttagctaacgtaccgtaaggttttcgaaccgtaaaacgggttcggggttacccctagttccgggtaacggtttaccgtaagggtccggtaccggtaagggtacggtacgttaccggtaagggtacgttacgttacgtttacgaaccttcctaacctaccgtagtacgtaacggttaacttacgtacgtaacgtaacggtagtaaacgttacgtttagtaacttaacgttacttaacgtcgttacaaacgttaagtaacttaactaagtttacgttaccgtacgaacgggtacctaacgtaacctaaataaacgtaaactaacgtacgtagtacctagaccgttacctaagttcgtacgtacttactacttacctaccgtacctacgtactacgtaac

SEQ ID NO: 142865 - DNA, 846 bp, Homo sapiens
  misc_feature: GYAE6OF02JO6BF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtctccactccctccctgtctgaccaaccggtgggaacgacaggtcgtaccaaccatccacgttcggcccgggtacaaacggtccgggaaactacgttcggaacctaaccctttaattttaaaacgttggtaacttaccgaaactaacgttacgaacccggaacggggaacccggtaccccgtaaaggtaccttacccgtaaatccgttaatcggacctacgaccgtacttcccgtaagtttcggaaccgtaaagggttccgggtaccctacggttaccgggtaggtttaccgacgggttacgacggtagggtacggtatccgggtagggtaactacggtacgtttaccgaaccttacctaacgtaacctacgtaacgtacgttaaaacgttccgtaacggtaaccgtaacggtaacggttaaacgtttacgttttaacgttaacgttaaccgttttaacgtttaacttaacgttaaactaaacgttaaaccgttaaactttaaaccttaacggtttaacgtttaaccggaaaccggttaaacggtaaccgtaaccgtaaaacgttaaaccgtaaaacgttaaaccgtaacgttacgtacgtacacggtaacctaccgttacttacttaccgttactttaccgtacgttacccgttacccgtaccttacttaccgtagttaccg

SEQ ID NO: 142866 - DNA, 670 bp, Homo sapiens
  misc_feature: GYAE6OF02FI1R4.46.67.G01.1.454.CMB.1.raw
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtctccatccctccctgtctgccaaccggtgggagactagtcgtcaaccatctacttcggccgggacaaggtacggaactattcgactaaccttaattttaaagttgtatacaaactagtacgacgacgggaccggcccctaagcctacctaactcgtatcgctgacctactcctagtttcgacgtaaggtcgggttacccagtccgaggttcaggtgcagtgagtcgtggaactagtattacacttctacacctatacgtaataagtcctacgaacgtacggtaagttaagttagttttacgaaccttaacgtttacgtttacgtacgtactaaacgtaaataacgttaagttaacgtttacgtttaacgacggttaacggaacgtaacgtaaacttaactaaaacgttaaacgtacgttaagtcgttacgtacgaccgttaacgtacttcgttacgttaccttagttaccttcccgtttacccgtactacgttccgttagtaaccg

SEQ ID NO: 142867 - DNA, 605 bp, Homo sapiens
  misc_feature: GYAE6OF02FFSTC.46.67.G01.1.454.CMB.1.raw
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctccatcagtagtggtttcttcgtggggctggggtccggcagcctcccgaggggaaggggctggaatacattggaagtgtctctcatagtggaggttcctattacaggtccgttctctcaagagtcgagtccaccatatctctgacacgtccagcaatctagttttccccngaagatcgtagttctggtgacccgccgctcgaaccgacggggtccttttattactgtcgacgtagagacggtctattagtgtagtttttggagttggttatttcgacacccgttagactcgggacggggcctcggaccccgtggggcccgaagggtaactacgtgggtccaccggttctaccgttacgccctccaccgaacgggaccctacgtcccggtccttcccccgtcggaccctccccgtccctaccgtacgacgtccc

SEQ ID NO: 142868 - DNA, 999 bp, Homo sapiens
  misc_feature: GYAE6OF02JV16L.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcgtagtagttcggtttcttcgtgggtctcgggtccggnacgcctccggaggggaaggggcctaggaatactagttagggaagttcgtcctctacagttaggtggtacggttacctagttactacggtccgttcttcctagtaaggtacgttccggaagttccaaccttaatacttaccgtttaccgacgggtaacctaccggttaacccgaaggtacctaaacgttacccgtttaaccggtttttacccccgtaaagggtaaaccggttagtaccggtttagttttaccgtacggttcccggtaacccgtcccggttaccggtacggtaacgggttacccggggtttacttttttaacgttacgtacgggttacggtaacgggtaacgaaccgggttaacgttccgttttaaacgtttaacggttttagggttttaaacggttttttaggggttaacggtttttaaccgggttttaacccgttttaacccggtacccgtttaaacccggtttaacggttaaccggggttaaccgggggttaacccggggtaccgggtttacccccggtaaccccgggggtttaccggggtaacccgggttaaaggggttaaccccgtttaccgggtttaccgggttaccccgttaaccccggtttacccgggttttaccccgttaacccgggttacccccgttaacccggtaaaccccggggtaacccgggtaccccgttaccggtttaccccggtttacccccgttccccggttaccggtacccccttaccccgttaccccgtacggtaaccggtacccgtaccccgg

SEQ ID NO: 142869 - DNA, 640 bp, Homo sapiens
  misc_feature: GYAE6OF02GDJ9Q.46.67.G01.1.454.CMB.1.raw
  modified_base (403)..(403): a, c, t, g, unknown or other
  misc_feature (403)..(403): n is a, c, g, or t
  modified_base (457)..(457): a, c, t, g, unknown or other
  misc_feature (457)..(457): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtcctgcaacggtgggagactagtgtccacctatcctacgttcggcccgggacaaggtaccgggaaactagttacgaacctaacctttaaattttaaagttggtaactacaaactataacggaaccgaacggggacccggacccctaagtcctacctaatctaatcgctcgactactaccgtagttcgacgtaagggtccgggtaccctagtcgtaggtacgaggnggcgtaggtgtatacggtaggtacagtacttcactcacacctatctactatcgngtacgagtagtagtattacgtaactacttatacgtactacaactaacgtaattactagttcggtttacgaacggtaacggactaactactaaactaaacgttaaacgtactagacgtacgtacgactactacttaccgtacgttaccttactaccgttcccgttccactacttcgacgttaac

SEQ ID NO: 142870 - DNA, 856 bp, Homo sapiens
  misc_feature: GYAE6OF02IJKMU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtgtttcttcgtgggctgggtccgcagcctccgagggacgggctaggaatactagttgggaagttgtctctcagttaggtcggtacggttccttaagttaccgtacgttccgttacctcttacgaaggtacgttcgacgttaccacctaattactcgtacgtacggaacctaccgtaccagacctaacttcgttaccgttttacccgtaggtaaacgtagttcgttacggttcttcggtaccggacccgtccggtctacggaaccggtacgggtttaccgtttttaacttacgtggttacggacggtaacggtacggtaccggttaactttaaggtttacgttaggttttaacggtttttagggaagggtttttttttttttttttacggtacggtttttaacccgtaacccgttaacccgttaacggtaaccgggttccggggtaccgggggtaccggttaccccgggtaccccgggttacggggtaacccggtaacggggtaacgttaccggttaccggttacccgttacccgttaccttacccgttaccgtaccccgtaacccgtaacccggtaaccgggtaccccgtacggttcccggttaccccgttacccccggttccggtacccccgttaccccgttacccgtaccggaccggtacccgtaccccgg

SEQ ID NO: 142871 - DNA, 632 bp, Homo sapiens
  misc_feature: GYAE6OF02H253K.46.67.G01.1.454.CMB.1.raw
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtctgtccctggtgcaactgcaggagtcgggcccacgactggtgaggccttcggagaccctgtccctnacctgcgctgtctcgtggtncctcatcagtagtggtttcttcgtggggctgggtccgcagcctccgagggaacggggctagggaactacagttaggaagtcgttactctcaatagtggtaggtttcctaattacagttccgtactcttacgaagtagtcgaagttcacctatacgtctcgtgacacgtccagcaagtctagtttccagaantagtattcngtcgaccgccgctagacgacgggttactttattacgtgtgtacgagtaagacgtactattatagtttagtttttaggaggtttaggtttacttttacgacctaaaccgttagtaagttaccgggacggggtctacccgggtaacccgttcggggacctaaggggtaaacttccggtaggtacccgtaccggttccctaccgtttacggccccttaacccgg

SEQ ID NO: 142872 - DNA, 647 bp, Homo sapiens
  misc_feature: GYAE6OF02GHP7O.46.67.G01.1.454.CMB.1.raw
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctcctgtctgcaccgtgganacngtgtcacatcacttgccggcaaggtcgaactnttgactacctatttaagttggtatcaacatacgacgagggacgcccctagctacctaatctatgctgcactccgtagtttcgactaaagggtcggggtaccctagtcggtaggttcaggtcggacgtagtggactcgtagggactaggtacttcacgtcctacacctatacgtagtactctagacgtaagtagtaagttattttacggacttaaacgtttattaaccgttacgttaacaaacgttaagtaaactttaactaacgtttacggtttaccggaaccgtaacgggaacgtaaccgtaacgttaaacgtaaaacgttaaaccgtaacgttagtacggtacttacggacctacgtaacgttcttacgttacttaccgtaacgttcccgttaccgcccttaacgttcgtacgttaaccg

SEQ ID NO: 142873 - DNA, 866 bp, Homo sapiens
  misc_feature: GYAE6OF02J2MS0.46.67.G01.1.454.CMB.1.raw
  modified_base (197)..(197): a, c, t, g, unknown or other
  misc_feature (197)..(197): n is a, c, g, or t
  modified_base (259)..(259): a, c, t, g, unknown or other
  misc_feature (259)..(259): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgacttggtgaggcccttcggagaccctgtccctcacctgcgctgtctctggtcgcctcatcagtagtggttcttcgngggctgggtccgctagcctccgagggagggctaggaactacgagttggaagtcgtctcgtanagtagtggtacggttcctagttacgagttcccgtactcctcgtaaagtacgtacgtaacgtcctaaccattaacttccgtacgtacgggtaccaaccgttcccaaggtacctaaaagttcccgtacggtttttcccccgagggtaaactaacgtcggtaccgttttcgtggtaccggtacccggtacccgtcggttcggtaaaccgtccggggggtttacttttaacgttacggtacggttcggaccggtagacgtacggtacttacgttaagttacggtttagttttagggtacgtttagggtttattaccggtaacgtaaccccgttagggtacgtccggggtaaccggggtccgttacccgggtacccggttaccgggggtaccgtaaccggggttaacttacccgggttacgtttaacccggcccggtttacccgttaccgtttaaccccgggacccctttacccggtaaaccccgggtaacccgggttaccccgttaacggtttcccccggttttcccccgtttaaccccccgttccggggttaacccccctaccccgtttaccccggtaaccccgtttacgggtaacccgttccccccggg

SEQ ID NO: 142874 - DNA, 708 bp, Homo sapiens
  misc_feature: GYAE6OF02HSS1E.46.67.G01.1.454.CMB.1.raw
  modified_base (207)..(207): a, c, t, g, unknown or other
  misc_feature (207)..(207): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccgnagctccgagggagggctaggatacagttggaagttgtctctcaagtcgtggagtttcctaattacagtccgtctctcaaggtagtacgacgttcaaccattagtctcgtaggactacgtccagacaatcgtacgttttcccagtaagtatacgtagttcctggtcgaccggtacctcgtacggaactaaccgggggtaccttttagttaccgtgtacgtacgaagtacggaacggtcttagttaagttcgttaagtttttggaaggtttagtttagtttccgaaccgtacccttagtacgtaccggtaccggggtcctaccggaccccggttcgggaccgtaacggggtaataccgttggaacccgtccggtactttcccgtaacgtcccttacccgaaccggtaaccgggtacccctacggttacccggttacccccttccccggttacgggacccccttacccccgttaccctaaccccggtaggtaaccccaccccgg

SEQ ID NO: 142875 - DNA, 685 bp, Homo sapiens
  misc_feature: GYAE6OF02FYN6P.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtggggctgggtccggcagcctcccgaggggaagggctaggaatacgtagttggaagttgtctctcaagttaggtggaggttcctaattacgagttccgtactctacgaagtagtcgagtccaaccgtatactctcgtacggaccgacgtccaagactaaacttctacgttttcccagaagacttgtagttctgtcggaccgcgtcgtacgaaccgtacgggttcgttttaactacgttggcgtacgaggaacggtacggtacttaagtttatgttagtttttgggagtttggttactttacggacctaccgtaggtacgtacggggaccgggttcctacccgggtaccccggtggggacccgtaagggtaaccgttacgttcggtaccgtacccgttcttaccgtaccgtccctaccgaccgtaaccggcccttacgtcccggttcccttccccggcgtccctaccccgtccgtaccgacggctacccg

SEQ ID NO: 142876 - DNA, 566 bp, Homo sapiens
  misc_feature: GYAE6OF02FTMSC.46.67.G01.1.454.CMB.1.raw
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (560)..(560): a, c, t, g, unknown or other
  misc_feature (560)..(560): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggtcaagtcgaacattgacacctattaatggtatcaacatagaccagggacgcccctaagctcctaatctatgctgcatcctaggtttcgacaaaaggtcggggtcccaagtcggaggtttcagtggcaggtggactcgtagggactagtactttcgaacttcgtaccacctatcagtaatctnacaacgtgaagtntttacgactaactattacngtccaaatagaacttataattcgttttacggacgtaacgggacacgtaactataaacgtaaagaactgtaggctacggactaccagttcctagtcccttacgtacgttacccgttcccgacctacttcgngtaacc

SEQ ID NO: 142877 - DNA, 873 bp, Homo sapiens
  misc_feature: GYAE6OF02GIHQ0.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagttggtttcttcgtggggtctggggtccggcagtcctacccggaaggggtaacggggctagggtaactaccgtagttgggaagttcgtacctcgtacagttaggtgggtacggttaccttaattacgacgtccgtctctacgaagacgtacgactaccaacctattactctcgtacggacctaccgtaccagactaacttaccgttaacggttttccccaaggtaacgtacgttaggttacgtttaccgtggtaccggaccccggtcccgtacgtttacggaccggttaaccgggggtttacgtttttaacgttaccgtcgggttagggaccgtaacgggtaacgggtaccggttacgtttaaagtttacggttaggtttaaggtttttaggggtagggttttcggttttaacgtttaccgtaaccgtaacccgttaggtacggtaccggggaccggggttaccggtaccccggaccccgggttcggggaacccggtaacgggttaaacgttccggttaccgggttacccgtacccggtttaaccgttacccgtttaccggtccccgtaacccggtaacccgggaacccgggttaccccgttaccggttaccccggttaccccgttccccccggtacgcccccgttaacccccgttaccccggtaaccggtaaccggtcccgtaccccgg

SEQ ID NO: 142878 - DNA, 658 bp, Homo sapiens
  misc_feature: GYAE6OF02IYNHG.46.67.G01.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (421)..(421): a, c, t, g, unknown or other
  misc_feature (421)..(421): n is a, c, g, or t
  modified_base (633)..(633): a, c, t, g, unknown or other
  misc_feature (633)..(633): n is a, c, g, or t
  modified_base (653)..(653): a, c, t, g, unknown or other
  misc_feature (653)..(653): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtcgttcttcgngggtctgggtcgcagctccgagggagggctaggaatacngtagagtntctcnctagagtggtacggttctagttacctagttccgtcgtctacaagtagtcgtacgtaccgaactattaacgtcttacgtacggtactaccgttccgaacgtactaacgttccttaaacggtttttcccccaaggtaaacctgtacggtagtttcgtcgttacggcccgtaccgtntacggaccggtacggttcgtttacttacgtgtcgtacgaggcgtacggtcgtaagttagtcgttagtttaggtaggttgttacttcgtactacgttagacggtacggtcgggtccgttacgccgggttacggcgtaaggaactcgtacgtcgaccgttctccgtactccgtaccgaccgtacgaccgtacgtccgttccctccgtacgcccncccgttaccacgtaccgtanacccg

SEQ ID NO: 142879 - DNA, 734 bp, Homo sapiens
  misc_feature: GYAE6OF02G8Y2B.46.67.G01.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (646)..(646): a, c, t, g, unknown or other
  misc_feature (646)..(646): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtcgggcccagactggtgaggccttcggacgaccctgtccctcactgcgctgtctctggtcncctcatcagtagttgtttctgtgggtctgggtccgcngccgtaccgagggacgggcgtaggaactacgtagttaggagttcgtctcgtactagtacggtaggtacgtttcctagttacgtacggttccgtctacgtacaggtgttccgacgtacacgtatacgtcctacgtacggacctacgtaccgatactaacttcgtttaccgttttacccgagtaaacgtgttacggtacgtttcgtacggtccggacccggtcccgtcgtaacggtaccggtaacgggtttaccgttttaactcggttggtacgtacggtaacgggtaccgtacggttactttaagttaggtttacggtttagggtttttaggtaaggttttaggtttacttaacccgtaccgttaaaccgtgggttaccgtaccggggtccgggtaaccncccggggtacccggtacggggtaccgtacggtacgtccggttacgtcccggttaccgttccgtttactacccgttccccgtaacccgg

SEQ ID NO: 142880 - DNA, 635 bp, Homo sapiens
  misc_feature: GYAE6OF02GCV0U.46.67.G01.1.454.CMB.1.raw
  modified_base (193)..(193): a, c, t, g, unknown or other
  misc_feature (193)..(193): n is a, c, g, or t
  modified_base (503)..(503): a, c, t, g, unknown or other
  misc_feature (503)..(503): n is a, c, g, or t
  modified_base (631)..(631): a, c, t, g, unknown or other
  misc_feature (631)..(631): n is a, c, g, or t
tcagactagcagtacacgaccggtgctcgatttagagtatacatattgggtttggggagtctcggtcaggacacagcatggacatgagggtcccgctcagctccgtggggctcctgctactctggcctcggagtgccagatgtagacatcgagctgacccagtctcactcctcctgtctagcaaccggtgganacgagtgtacacgatcctacgttggccggataacggtcgaactgttacgactaccttaattaagtcgtactacgaactagtaaccgacgacgggtaaccggtaccctacgtacctacctaagtactactcgtctcgctactccgtagttcgaacgtacggtacgggtaccagttacgtacggttacgacggtacgacggtaggtacgacgttcgagggtaactagttactaactccgtacttaaccgactacgtagtactaatccgtagaccgttaagtacggtaattacttacgtacctaaattcgtanacgactaacgtaatactactaagttcgacgacgtaacgcttaaacgacgttaaacaactacgtaactggacgactacgtcctaaccgagttaccttagcttacgaccttacctccgatacgtcgttanaccg

SEQ ID NO: 142881 - DNA, 723 bp, Homo sapiens
  misc_feature: GYAE6OF02G3WK7.46.67.G01.1.454.CMB.1.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcgcctcatcagtagttgtttctcgtgggctgggtccgcagccgtccgaggggacgggctaggaatacagttggaagtcgtctcnctataggtggtaggttctatacngtccgtctctcaagngtcgacgtccaacctatactcctacgtcggacctacgtaccaagacctaattccgttaaccgttttcccaaggaaacgttataggtacgtttctcggtaccgaccggtccgtacgtacggaccggttacgggttacttttaactacggtggtacggacgtaggaacggtaccgttaatttagtttacggttagggttttaacggtttttagggtacggttttaggtttacgtttaaccggaacccttacggttaaggtacggtacccggggtaccgggtccggttaccccggtaccgggtccgggtaaccggtaacgggtaaccggtttcggtaccggttacccgtacccggttacccgttaccggttacccgtacccgtaacccccggg

SEQ ID NO: 142882 - DNA, 764 bp, Homo sapiens
  misc_feature: GYAE6OF02H2IP6.46.67.G01.1.454.CMB.1.raw
  modified_base (98)..(98): a, c, t, g, unknown or other
  misc_feature (98)..(98): n is a, c, g, or t
  modified_base (240)..(240): a, c, t, g, unknown or other
  misc_feature (240)..(240): n is a, c, g, or t
  modified_base (328)..(328): a, c, t, g, unknown or other
  misc_feature (328)..(328): n is a, c, g, or t
tcagactagcagtacacgaccggtgctcgatttagagtatacatattgggtttggggagtctcggtcaggacacagcatggacatgacgggtccccgntcagctccgtggggctcctgctactctggctccgaggtgccagtatgtgacagtcgagctcgaccctagtctccatcctcctgtctgaccaaccggtgggaacacgtagtcgtaccacctagtcgtacgttcggcccggganaaggtccgaaatagttcgactacgttaatttaagtgatacagactacgaccgaggccgtaccgtagtcctacgtaatcctatcgactnacctataccgtagtttacgaacgtaaacgggttcggaccctagttacggtacgttcaaggtcgacgtaaggtcgacgttacggacggaacgtacgtactttccgaaaccgttcctaaccggtaactaacggtttcgtaaacgttaacgttccgaaggtaccgtaaagttagtaaagtttacggttactaacgttaactttaacgtacgttaaacggtaactaaaccgtaagtttaaaagtaccgtaggtttaccggttaaccgggaaaccgttaagaacccgtaaagtaaccttaaaacgttaaaacggtttaaaccgacgttttaccggagtacccgttaacggtaaccctaacgttaacgttaccgttacttacccgttccgtttaaccctacccggtttaaccccgattaaccggttccggtaattaacccgg

SEQ ID NO: 142883 - DNA, 718 bp, Homo sapiens
  misc_feature: GYAE6OF02FZPG9.46.67.G01.1.454.CMB.1.raw
  modified_base (209)..(209): a, c, t, g, unknown or other
  misc_feature (209)..(209): n is a, c, g, or t
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
  modified_base (598)..(598): a, c, t, g, unknown or other
  misc_feature (598)..(598): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgnagctccgagggagggctaggaatacattggaatgtctctanagtagtggtagttcctattacagtccgtntctcaagngtcgatccactatatctcgtagacncgtacagacatcgtacgttttccagaactatggtacgttcgtgtcgaccgcgacttggacgtacggggtactttttaacgtaccgtgtacggagaacggtacggtacggtacttaagtttagtaggttttaagttttaggggtaagttttacggtttacgtttccgaaaccgttacccgttaagtaccggttaccgggtaaccgggggttaccttacccggggtaccccggttacgggggacccggtaaaggggtaacttacggttacggtaccgtaacccggttnttacccggtaccgtcccgtacccgtaaccggtaacccggtacccgttacgttacccggtttccccttaccccggtcgtaccccttaccccgttaccccgtaacgtaccgtagtaccccgg

SEQ ID NO: 142884 - DNA, 605 bp, Homo sapiens
  misc_feature: GYAE6OF02GUO0O.46.67.G01.1.454.CMB.1.raw
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctgacccagtctccatcctccctgtctgcaaccgnggganacagtgtcaccatcacttcgccgggcaagtcggaacattgacaccttatttaaattgtatacaacatagaccagggaccggacccctaagcctcctaatctatgctgcactcctaagtttcgacgtaaaggtcggggtaccccagtcggtaggtttcagtcggcaggtggatcgtagggacagtatttcacttctcaccatcagttaatcctgacgaacgtgaaagttatttcgacttaactttattaacgtagttaacaactaagtaacttaacgtaatttcggtttaccggacgtaacgggtaccaacgtactaaacgttaaaataaacgtaacttaggtacgtctagtaccgaaccgtacttctacgttaccttacgtacttccttccccgacttacgttctacgtac

SEQ ID NO: 142885 - DNA, 752 bp, Homo sapiens
  misc_feature: GYAE6OF02G8UFR.46.67.G01.1.454.CMB.1.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
  modified_base (664)..(664): a, c, t, g, unknown or other
  misc_feature (664)..(664): n is a, c, g, or t
tcagactagcagtacacgaccggtgctcgatttagagtatacatattgggtttggggagtctcggtcaggacacagcatggacatgagggtccccgctcagctcctggggctcctgctactctggcctccggaggtgtcagatgtgacagtcgagctgacccagtctaccatccctcccgtgtctcgacaaccgtggganacgagtgtaccaccntcgacttcggccggganaacggtaccggaaacngttacgacctaccttaatttaaacgtggtatacaanatagaccgtagggaccggacccctaagcctactaactctaatcggactcgacacttaccgagtttacgacgtaaaagggttcggggtacccctaagttccgggtaaggtttacaagggttcggctagggtaggtacttaccggttaggggactaaaaggtcgttttacccaactccttaacaaccttacgtacgttaacgtaaacttccgttagaccgtaaagtacgggtaattacgtttacgaccttaaagttttatacgttaacgttaccaaattaaggaaactttaaacctaggtttacgttttaccgggaacccgtaaacgggtaaccggttaaacaaccgtttaaacgtaaaaacgttaaaccgttaaaaccggngtttaaccggacgttaccggaaccaccttaacgtcgttacgtcctttacgttaccttccggtaccccttacgtaacttcgtataacgg

SEQ ID NO: 142886 - DNA, 809 bp, Homo sapiens
  misc_feature: GYAE6OF02J0LZ0.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtcgcaactgcaggagtcgggcccacgactgggtgaggccttcggagccctgtccctnacctgcgctgtcctcgtggtcgccctcgatcaagttgttggtttcctcggtggggcttcggggtaccggcagccgtaccgaggggaagggctagggaactactagttacggaagttgtctctacagttaggtggtacggttccttaattacgacgttccgttactacgtcgtaacggtacgtcggtaacgtcaacctattacgtctacgttacggacctaccggtaccgagtactaaacgttccgttaaccgtttttaccccgaggttaaacgtacgttacggttacgtttccggtaggtaccgacccgtacccgtacggtacggtaacccggtacggggtttacgttttaaccgttacgttcggttacggacggttaacggtaacgggaccggttacgtttaacgtttaacggtttcgtttaaggtttttacgggtaagttttacgggtttaccgttttaaaccgtaaccgttacccggttaaggtacccggtttacggggacccgggttccttaaccccggggtaccggttaccgggtaccggtaacgggtaacgttacggttaccggtacccgttacccgttacccgtttccgtaacctcccggttaacccgg

SEQ ID NO: 142887 - DNA, 709 bp, Homo sapiens
  misc_feature: GYAE6OF02F7FT5.46.67.G01.1.454.CMB.1.raw
  modified_base (330)..(330): a, c, t, g, unknown or other
  misc_feature (330)..(330): n is a, c, g, or t
  modified_base (363)..(363): a, c, t, g, unknown or other
  misc_feature (363)..(363): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttggagaccctgtccctcacctgcgctgtctctgtgcctcatcagtagtggtttcttcgtggggctgggtccgcaggcctcccgaggggaacgggctaggaactacgattgggaagttgtctctacagttaggtaggacggtttcctagttaccagttcccgtcgtctaccgaagacgttcgagtccaaccgattacnctctgaccacgtccagcatcgtacgttttccgngaacgtattcgagttctggtcgtaccgcgtaccgtgaaccgtacggggtacgtttttaattaccgtgttcgacgtacgaggtaacgggtccttagtttagtttacggttacgttttttaggggacgggttttggttttaacgttttaccggaacccgttaaccgtaggtacgttcccggggacgggggtccgttaacccggaccccgggttcgggggaccgtaacggggtaactaccggttcggtacccgtaccgttcttacccgttacgtcctacccaaccgtaccggacctacgttccggtaccttccccgtcggacctcccctacccgtaccgacgacgtccg

SEQ ID NO: 142888 - DNA, 801 bp, Homo sapiens
  misc_feature: GYAE6OF02HRDBM.46.67.G01.1.454.CMB.1.raw
  modified_base (173)..(173): a, c, t, g, unknown or other
  misc_feature (173)..(173): n is a, c, g, or t
  modified_base (207)..(208): a, c, t, g, unknown or other
  misc_feature (207)..(208): n is a, c, g, or t
  modified_base (245)..(245): a, c, t, g, unknown or other
  misc_feature (245)..(245): n is a, c, g, or t
  modified_base (460)..(460): a, c, t, g, unknown or other
  misc_feature (460)..(460): n is a, c, g, or t
tcagactagcagtacacgaccggtgctcgatttagagtatacatattgggtttgtcctcctgctggtggcagctcccagatgggtcctgtccctggtgcaactgcaggagtcggccacgactggtgaggccttggacgaccctcgtccctcaccgtgcgctgtactctggtcncctcatcgagtagttgttctgtgggcttggccgnngctccgagggtaggctagaatcgagtggagtgtactngaactagcggtaacgttcttaatagacgttcctctctacgaagtgtacgacgtcaccgtattacgtcgttcgacggacctaccgtaccgagtacaacgttcgttaaccgttttccgaagtaaagtgtacggtacgtttacacgggttcgacccgtactcggtacgaaccgttaacggttcttaagtaccgtgttcggacgaggtacgaccggttnttaagttcgttagttacgggttttgaacgggttttacgttacgttaaccgtaacccgtttacggtaaacgtacgggttaccggggtaaaccgggttcccgttaaaccccgggttacccgggttaaccggggtaacccggttaaaggttaaaaccgggttccgtttaacgggttaccccgtacccgtttaacccggtacgtttaaccgacccccgttttacccggaacccggttaaaccgggtaccccgttaacggttcccccgggtttttacccctaacccccggttcggtaaacccccttccccggttaacctaaccggtaacccggaccgttaccccgg

SEQ ID NO: 142889 - DNA, 677 bp, Homo sapiens
  misc_feature: GYAE6OF02HKGGI.46.67.G01.1.454.CMB.1.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccggnaagtcgacatgacactatttaaatgtatcaanatagaccagggacgacccctaagcctcctaatctatgctgcatccctagtttgacctaaaaggtcgggtaccctatcggacggttcagttggacaggtggatcgtagggaacaggtatttcacgtctaccacctatcgtaagttaactacgtgtaaccgtaaacgtacggtaaaagttagtttttacgaaccttaaaaccgttttattaacgttacgttaaccaaactaaacgttaaattaactaaacgttttcggttttaccgggaaccgtaaacggtaccgtaaaccgtaacttaaaacgtaaaacgtttaaaaccggtaaacgttaggttaccggtaccgtaagtaccgtaaacctacttccttaggttaccctttacgttaaccttcccgtttaccccggaaccctacgttaccgttagttaaccg

SEQ ID NO: 142890 - DNA, 799 bp, Homo sapiens
  misc_feature: GYAE6OF02HT9F1.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattgggtttgtcctcctgctggtggcagctcccagatcgggtcctgtccctggtgcaactgcaggagtcgggcccacggactggtgacggtccttggagtacccgtgtccctcaacctgcgctagtcctcgtggtagccctccatccgtagtagtgtttctcgtcggggtctagggtccganacgtccgtcccgaaggggtacgggtctaggtaactacgtagttacgggaacgttcgtactactcgtaagttacggtacggtaacggttaccttaacgttaactacggttacccggtacttaccgtaaccgtaacggtacggtaccgtacggtaacctaacccgaagttaacctacgtcgtaccggacgtaaccgttaccgacgtaacgtaaactccgttaacgtttaccccgtaggaacgtagtacgtaagttccgtacgtcgaccgtcgtactacgacggtaacgtacgtttactaccgttgtacggacgtacggtaacgtacgtaacttaacgtaagttgttaacgtttaggtagttacgggtttacttacggtacctaacggtacgtaacgtcgggacgggtcgtccgtacccggtaggccgtaaggtaacgtcgtacgtaccgtacgtccgttaccgtaccgtaccgtaacccgaccggtaaccggtacctaccgttcccggttaccccgttaccccggcgtaaccccggtccccttaaccccggtaaccgtaccggtactaaccccgg

SEQ ID NO: 142891 - DNA, 735 bp, Homo sapiens
  misc_feature: GYAE6OF02F207U.46.67.G01.1.454.CMB.1.raw
  modified_base (211)..(211): a, c, t, g, unknown or other
  misc_feature (211)..(211): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgtcctcctgctggtggcagctcccagatgggtcctgtcctggtgcaactgcaggagtcgggcccacgactggtgaggccttcggagaccctgtccctcacctgcgctgtctctggtgcctccatcagtagttggtttcttcgtggggctgggtccggnacgctcccgaggggagggctggaatacagttgggaatgtctctcaagtagtggaggttcctattaccgagtccgtctctacaacgagttcgacgtcaacctatatctcgtggacacgtccagctaattcgtacgttttccctagaagtnttcggtattcgtggtcgaccgtccgcgttacggacgtacggggttacgttttacttacgttggtcggtacgaggaaggtaccggtacgttaagtttaagttaggttacggtttttagggttagggttttaggttttacgtttaccggtacctaacccgttaggtacggttaccgggacgggggtccttacccggtacccggtacggggtccgtaacggggtaacttacggttcggtacctcccggttaccgttccgttaccgtccccgttaccgaacccggtaaccgggtacccttacgggttacccggtttcccgtttacccccgtccggttaccccttaccccgtaccctaacccgtaaccgaccggtacccc

SEQ ID NO: 142892 - DNA, 710 bp, Homo sapiens
  misc_feature: GYAE6OF02IUSV6.46.67.G01.1.454.CMB.1.raw
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgagggcctttcgggagacccctgtcccctcacctgcctctgtctctggtcncctcatcagtagtgttctgngggctgggtccgnagctccgagggagggctggaatacgagttaggagtcgtctctcaatggtggtagttacctattacagttccgtctctacgaaggtacgtcgacgtccacctatactctcgtacggacaccgtccagtacctaatcttacttttccgagaacgtatacggtgtttacgtggtaccgacccgtccggtacgtacggaaccggtaccgggttacgttttacttacggtcggtggacgtaggtacggtaccgtattaagttacgttagtttacgtttagggtagtttggttacttacgaccttaccgtagacggtaccgggtacgggtccgtaccggtacccgggtcgggtaccgtaagggtaaccttcggtccgttaccgtccgttaccgtaccttaccgtcccgtaacccgtaaccgggaccgtccccgtacgttccccggttacccttccccggtacgtccctacccccgttacccgacgtaaccggtccctacccgg

SEQ ID NO: 142893 - DNA, 922 bp, Homo sapiens
  misc_feature: GYAE6OF02HGS93.46.67.G01.1.454.CMB.1.raw
  modified_base (223)..(223): a, c, t, g, unknown or other
  misc_feature (223)..(223): n is a, c, g, or t
  modified_base (506)..(506): a, c, t, g, unknown or other
  misc_feature (506)..(506): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccaacgactggtgacggccttacggacgaccctgtcccctcaccgtgccgtctggtctcgtgggtcnccctaccatcaaggttacgttcggttttcttcggtgggggtccttgggggtcccggcacggtcctaccccggaagggggaacgggggtcgtacgggaaataccgaagttagggaaacgttcgtctctcaagttaggtaggtacggtttacctaagtttaacacggttccgttactcgtactaaaggacgttacgacgtaccaacctaataccttcgtaccgtaggacctaccggttaccaagtacctaaattccgtttaacgttttcccaaggtaaaacggtntttacgtaagtttcccgttaggtaccgtaaccccggtcccggtaacgttacgggtaaaccggtaaccggggttaccgtttttaaagtttaccgttaggttcggtaacgggtaacggtaacggtaaacccggttactttaaacgttttaacgttaggttttaaacgggttttttcggggtaaaggtttacgggttttttaacctttaccggaaaacccgtttaaaccccgtttaagggaaacccgtttaacccggggggtaccgggggtaacccgtttaccccggggtaacccccgggttaacggggggaacccttaaaacgggggtaaacctttaccgggtttaccgggttaacccgttaaccccggggtttacccgtttaaccccggttttacccggacccccttaaaccccggg

SEQ ID NO: 142894 - DNA, 873 bp, Homo sapiens
  misc_feature: GYAE6OF02GD0U8.46.67.G01.1.454.CMB.1.raw
tcagactagcagtacacgaccggtgctcgatttagagtatacatatgggtttgtcctcctgctggtggcagctcccagatgggtcctgtccctggtgcaactgcaggagtcggcccacgactggtgaggccttcggagaccctgtccctcacctgcgctgtcctctcggtcgcctccgatcagtacgtcggttccttcgtcgggtcctgggtcccgcagtcctcccgagggtaacgggtcctaggaactacagttcggaacgttcgtcctccgtacagtacgtcggtacgttaccctaagttaaccgagttccccgtaccttccgtacaaacggtacgtccgaacggttccaacccgtaacgttaactccttaccgtacggaacctaaccggttacccagtcctaaacttccgtacgttttacccctaggtaacgtaacttcggtacgtttaccgtagttaccggtaacccgccccgttacgtacggaaaccgtaccggggttccttttaaattacccgtcggtacgacggtacgtaacggtaccggtaccgttaacgtttacgttacgttagtttttacggggaacggttcggttaacgttttacccggtacccgtaaccccgtttaggtaaccgttacggggacccggggtttaccgttcccgggtaaccccgggttagggggtaccccgtaagggggttaaaccttaccggttaccgggtacccgtaaccccggttccttacccgttaccggtccccgttacccgaaacccgggtaacgggtacccctaacggttcccgggtaccctttacccccggtggtacccccgtaccccgttacccgtaacccgtaaccggtacgtaacccccgg

SEQ ID NO: 142895 - DNA, 836 bp, Homo sapiens
  misc_feature: GYAE6OF02I09OY.46.67.G01.1.454.CMB.1.raw
  modified_base (173)..(173): a, c, t, g, unknown or other
  misc_feature (173)..(173): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggcctttcggagaccctgtccctcacctgcgctgtctctggtncctccatcagtagttggtttctcgtggggctgggtccggcagcctccgagggagggctggaatacagtggagtgtcnctnatggngagttcctatnagtcctctcncaagtgtccgagtccaaccagtactctcgtaggaccaccgtaccagtccaaacttcgttaccgtttttccccgtaggaaaacgtcgttagtaacgttttcgtacggtcgacccgtacccgtagttcgaaacccggtgggggttaaccttttaaggttaccttcgggttacgaccggtaaggaaccggtaacggtaccgtttaatttacggttaggtttaagtttttaggggaacgttttaggttttaaccggttttaccgaaccgttaacccgttaacgtacggttacccgggggtacccgggggtaccgttccccggtacccccgggttaacgggggtaccccgtaaagggggttaaacccgtttacgtaccggggttaacccggttacccgtaccccgtttacctttaacccgggacccccttttaaccggaacccccggttaacggggtaaccccccttagggttccccccgggtttaacccccgtttcccccggaccgggttacccccttaaccccgtacccgtaccccgttaaacgggaccttaccccccgg

SEQ ID NO: 142896 - DNA, 644 bp, Homo sapiens
  misc_feature: GYAE6OF02FOJDI.46.67.G01.1.454.CMB.1.raw
  modified_base (293)..(293): a, c, t, g, unknown or other
  misc_feature (293)..(293): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccggcaagtcgaacatgactacctatttaaatggtatacaacatagaccagggaccgcccctaagctcctaatctatgctnctatcctagtttacgacgtaaaggtcgggtacccagtcgaggttcaaggtgactaggtggattcggaggactagtactttcacttcctacacctaatcaaagttaactctagtacctaacggtagtaaagttactttgaaccttaaacttacttaacgtacgtactaaacgaacgttaaattactaagttcgtttaccggaacgtaaccgggtactaaccggtaacttaaaacgtaaaagttaaaccgtaacgtggtacgtacgtacgtaccgaacctaagttcctaacgtttcccgtttaaccttacgttcccgttaacccccgtaccgtaaccttcgttaccgtaaccg

SEQ ID NO: 142897 - DNA, 688 bp, Homo sapiens
  misc_feature: GYAE6OF02JT1IN.46.67.G01.1.454.CMB.1.raw
  modified_base (221)..(221): a, c, t, g, unknown or other
  misc_feature (221)..(221): n is a, c, g, or t
  modified_base (643)..(643): a, c, t, g, unknown or other
  misc_feature (643)..(643): n is a, c, g, or t
tcagactagcagtacacgaccggtgctcgatttagagtatacatattggtttggggtaggtctcggtcaggacacagcatggacatgagggtccccgctcagctcctggggctcctgctactctggctccgaggtgccagatgtgacatcgagctgacccagtctccatcctccctgtcctgctaaccgtgggagacagtgtccaccatcacttgccgggnaacgtcggaaccagttgacctaccttaatttaaagttcggtactacaacgtactaacgtaaccgaggggaacccggtacccctaaacggtccttacccgttaaacgttccttaacgttcgtactcgtaccgtaacttcccgtagttttaccgacgtaaacggttcggggttacccacttcggtaacgttcggagttcggacgtaggtcggtaatcgtagggtaacacggttaacttcgtactcgttcaacccgtactcgtacgtaacttcgtacgtacgtaacggtataacgttatttacgaaccgttaatttacttacgttacgtacctaaagtagtaaccttaagtactttacggttacgaccgaagtaccgtacgtaactaataaactaaacgtacgtgtacgtactacgcctaacgtnttacgacttcgttacacgtttcctaccacctacttacgactaacg

SEQ ID NO: 142898 - DNA, 669 bp, Homo sapiens
  misc_feature: GYAE6OF02HZ361.46.67.G01.1.454.CMB.1.raw
  modified_base (173)..(173): a, c, t, g, unknown or other
  misc_feature (173)..(173): n is a, c, g, or t
  modified_base (214)..(214): a, c, t, g, unknown or other
  misc_feature (214)..(214): n is a, c, g, or t
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtcgaggccttcggagaccctgtccctcacctgcgctgtctctggtcncctccatcgagtagtggtttcttcgtcgggctgggtccggnagcctcccgaggggaacgggtctaggaatacgagttacggaagttgtctcgtacagtagtggtacgttcctattacncgtccgtntctcaagtcgtcgagtcactatacgtctcgnggacacgtccagacaattctacgtttccagtaacngtgtagttcgtcgtcgaccgcgacgtagacgtacggtactttacgtacgtgtcgacgaggcgtacgtacgttattagtgttagtttggagttaggtttacttacgaccgtacttaggacgttccgggacggggtcctaccggtcccggtcgggaccgaggggttaacctacggttccgggaccctacggttacccgttaccgttaccgtcccgtaaccgtaccggaaccggtaccctacggttcccggttacccgtttccccggtacgtccctcccgttaacccacggtaccgtacgtaacccg

SEQ ID NO: 142899 - DNA, 818 bp, Homo sapiens
  misc_feature: GYAE6OF02GM6MY.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgaggtcccgctcagctctggggctcctgctactctggctccgaggtgccagatgtgacatcgagctagacccagtctccatcctcctgtctagcgaaccgtggacncgagtcgtcacctagtcctacgttcggccgggtactaaggtaccggaactatttcgaaccgtaccttaattttaaaagtggtaacctacgaaacgtacgttaacggaaccgtaacggggtacccgtaaccccttaaaggtcccttaccgtaagtcccttaagtcgcgttcggactacgttacccgttaggtttacgaaccgtaacgggttacgggtccctagtcggtaaggttcgtaaggttcggactaacgggttagacgttcgggtaacggtacctaagggttaccttacgtaaccgttctaaccgtaaacctacgttaacgaacggtttaacgtaccggtactaacgggtaacgttacggtaacgtttaacgtttacgaaccgtttaacggtttacttaacgttacggtaaactaaacgtaagttaaactttaacgtaacgtttacgggtttaccggaaaccggttaacgacggttaacgtaaacgttaacgttaaaaccggttaaacgtaccggttacgtttaccggaccttacgtaaccggtaaccgttaagttcgggttaccctttaacgttaccgttaccgttaccgttaccccgtacttcccggttagtcccgttaacc

SEQ ID NO: 142900 - DNA, 716 bp, Homo sapiens
  misc_feature: GYAE6OF02FI4XM.46.67.G01.1.454.CMB.1.raw
  modified_base (141)..(141): a, c, t, g, unknown or other
  misc_feature (141)..(141): n is a, c, g, or t
  modified_base (173)..(173): a, c, t, g, unknown or other
  misc_feature (173)..(173): n is a, c, g, or t
  modified_base (196)..(196): a, c, t, g, unknown or other
  misc_feature (196)..(196): n is a, c, g, or t
  modified_base (348)..(348): a, c, t, g, unknown or other
  misc_feature (348)..(348): n is a, c, g, or t
  modified_base (380)..(380): a, c, t, g, unknown or other
  misc_feature (380)..(380): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcgganaccctgtccctcacctgcgctgtctctggtcncctcatcagtagtggttcttcgngggctgggtccgcagcctccgagggacgggctaggaactacgagttcggaatcgtactctacagttaggtggtacgttccctatttaacacggttcccgttctcttacgaaaggtcggttacgagtccaacctatacgtcctcgtaggaccncgtccagcctaagtctacgtttccagtaagtntagtacttctggtaccgaccgtcgtcgtacggacgtaccgggtttcttttaactccgtggtacgacggacggtacggaccgttattaactttagttggtttagtttttgggaggtttcggtttaacttttaccggaaccttacccgttagtaacgggtccgggtaccggggtccttacccggtaccccgggtggggtaacccgtaggggtaaccttaccggttcgtacccgtacggttcccttaccgtacgtccccaccgaccggtccggtaccctccggttcccgttccccgtaccgtaccgccctaaccccgttcgaccgtacgtccgtacccg

SEQ ID NO: 142901 - DNA, 728 bp, Homo sapiens
  misc_feature: GYAE6OF02IWY21.46.67.G01.1.454.CMB.1.raw
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgccgctgtctctggtgcctcatcagtagttggtttcttcgtggggctgggtccggcagtcctcccgagggagggctggaatacgagttggaagtgtctcncagtgtggaggttcctattacgagtccgtctctanaagngtcgagtccacatatcctntcggacacgtaccagacaactcttacgttttcccctagaatacgttagtagttcctggtcgtacccgccgtcctcggtaaccgtaccggggttacgttttacttaccgttcgtcggtacggacgggtaacggtaccgggtacgtttaagtttagtttacggttaggtttttacggtaggtttaggttttatttaccgtactaaccccgtagtagtaccgggtacggggtccgtaccggtacccggtcgggtaccggaacgggtaagttacgtccggttccgtaaccggttccgttcccgttaccgtccgtacccgacccgtaaccgggtcccgtacggttcccggttccccgtttccccggaccggttacccgtacccccgttacccgtacccgtaaccggccgtaacccccgg

SEQ ID NO: 142902 - DNA, 664 bp, Homo sapiens
  misc_feature: GYAE6OF02F26XJ.46.67.G01.1.454.CMB.1.raw
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagcctcccgaggggaagggctgggaatacagttggaagtgtactctcatagtggacggttcctattacagtccgtctctcaagngtcgagtcaccatatctctggactacgtccagacaatctacgttttcccgngaagtntacgtagttcctggtacgacccgccgtacgtcgaaccgtcggggttacttttagttacgttcggtgaccggagacgacggtacttagttagtgttagttttggagtttggtttacttacgaccaccttagacgtacgggtaccggggtctccggaccccggtggggaccgtacgggtatacggttacgtccgtaccggttccttacccgtcgtccctacccgtacccggaacggtaccccacggtttcccggtccctttacccccggtggtcccccgtacccgttaccccgacccgtaacggaccgttaccccg

SEQ ID NO: 142903 - DNA, 795 bp, Homo sapiens
  misc_feature: GYAE6OF02JHZSA.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtcctcgtggtcgtcctccatcgagttagttcggttttcttcggtcggggtcgtcgggtccggcgagtcccgttcccggaacggggtacggggcgtggtaactacctaggttagggtaaggtgttcctctacctagttaggtgggtacggtttacctacttaccgtacggtccgttccgttactacgaaggtacgtacgacgttaccaaccgtatacttcctacgtacggtacctaccggtccgtacgactaacttacgtaccggtttttaccccgtaaggtaaaccgtgttaacgtacggtttttacgtacggttacccgtacccggtacccggtaccgttacggaaccggttaccggggtttaacgtttttaccgtttacgttacggttcggacggttaacgaacgggttaccggtacgttacgtttagtcgtttagttttaggggtagtttacgtttagttaccggtaccttaaccgtaaggtacgtacggggtaccgggtcggtaccccgtcccgggttcgggtaaccggaggttaacgtaccgtcggttaccgtaccgttcccgttacgttaccgtcccgtaaccccgg

SEQ ID NO: 142904 - DNA, 641 bp, Homo sapiens
  misc_feature: GYAE6OF02GJRI1.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtgggctgggtccggcagctcccgaggggaagggctaggaactacagttggaagtgtctctcatagtggaggttcctattacgagtccgtctctacgaagagtcgagtccacatatctcgtcggacaccgtccagactaatcgtacgtttccagaagatgagttctggtacgaccgtccgctcgacgtacgggttctttacttacgtgtcgcgagagtacgattagttatgtttagttttggagttggttattacgactacccgtagtacgtacggacgggtcctacccggtccggtacggggaccgaagggtacttaccggtcgtccgtacccgttccgttaccgtccgtccctaccgaacccgtaccggaccctaccgttcccggttcccgttccccggtacggtcccctaccccgttacccgtacccgtacggcccgtacccg

SEQ ID NO: 142905 - DNA, 946 bp, Homo sapiens
  misc_feature: GYAE6OF02H1D64.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctntctgcgaacgtggagacagtcgtacacctatcacgttcgccgggactaaggtacggaaactagttacgaacctaaccgttaagttttaaaacgtttcggttaactaacctaaaccgtaaagttaaccggaaacccggtaacgggggtaaaccccgggtaacccccgttaaacggttaccgttaaacccccgtttaaattacccgttaacgttcggtacccgttacggaccttaaccgttacccgtttaaggtttttaacggaccgttaaaaaccggggtttccgggggttaaccccctaaggtttacccgggttaacgggttttcccggaagggttacgggaccgttaagggttccggggtaagttaccggttaggggtaacccttaagggttaacttttccgaaccgtttacctaacccgtaccgtactttaccctaagtttaacctttccgtaacggtaaccgtaacggttacgggttaacttacgttttacgaacgtttaaacttttaacgttaccttaaggttaaaccctaagttaacgttaaacgtttaacgtaacgtttttacggggtttaacccgaaacgggtaaaccggtaccgtaaaccggtttaaaccgtaaaccgtttaaaacggtttaaaaccccgaggtttacgtaccggtagttaaccccgtacgtaaccgttaccgtttaccggttaccgtttaaccttccgttaccccgttacccgtttacccccgttaacgtactttccggtaaccgttaaccg

SEQ ID NO: 142906 - DNA, 703 bp, Homo sapiens
  misc_feature: GYAE6OF02FQU5O.46.67.G01.1.454.CMB.1.raw
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccggcagctcccgaggggaggggctggaatacagttggaagttgtctctcataggtggacggttcctattacagtccgtctctcaagngtcgagtcaccatactctctggacacgtccagcaatctagttttcccagaacgtntgtattcgtgtcgaccgtccgctagaccgtacggggttcgttttacttacgtggtacgtcggaggaacggacggtacttactttagtagtttagtttttggggtagtttaggtttacgtttaccggaaccgtacccgttagtacggtccgggtaccgggggtccttcccggtaccccggtgggggtacccgtaaggggtaaccttacggttcgggtaccgtacccggttccgttacccgttaccgtccctacccgtaccggtaaccgggtccccttaccgggttccccgttccccgtttcccccggttcggaccccttaccccgtcccgtacccgaccggtaccgtaccccgg

SEQ ID NO: 142907 - DNA, 680 bp, Homo sapiens
  misc_feature: GYAE6OF02GV4JC.46.67.G01.1.454.CMB.1.raw
  modified_base (318)..(318): a, c, t, g, unknown or other
  misc_feature (318)..(318): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactcctccctgtctgccaaccggtgggacacgagtgtccaccataccacttcggccggacaacggtcggaactagttcgactaccttaatttaaattgtatacaacatacgaccgacggaccgacccctaagcctacctaactactactnctcgactactccgtagtttcgacgtaaacggttcgggtaccctagtacggtacggttacgtaggtcggacgtaggtacggtacgtcggttagggtaacgtacggttacttaccgtaccttaccgtaccaccgtactacgtagttactcgtagtacgtaacgtagtaagttactttacgacttaactttattacgtacgtactaacgtaacgttaacttaacgtaacgtttcggtttaccggaaccgtaacggacctaaccgtaactaaaccgttaaacttaaacgtaacgtgtacgtactacgaccgtactaacttgtacttaccgttctaccttacctaccctcctacgttacgtataacg

SEQ ID NO: 142908 - DNA, 636 bp, Homo sapiens
  misc_feature: GYAE6OF02G8HAI.46.67.G01.1.454.CMB.1.raw
  modified_base (235)..(235): a, c, t, g, unknown or other
  misc_feature (235)..(235): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggacgacagtgtcaccatcacttggccgggcaacggtcggaactnttgacctaaccttaattttaaagttggtaactacaaactagtaacgaaccgacggggaccggtaccccctaagccttacctaaatctatgctagcactccgtagtttcgactaaggtcgggtacccagtcgtaggtcaggtgctaggtgtatcggtaggactagtattccacgttctaccactactacgtaagtactctacgtaactaacggtagtaaacgttatttacgaccttaaattacgtttactacgtaactaaacagttaaacttactagtttcgttaccggacgtaacgggactaacgtaactaactaaaacgtaacgtaacgtgtacgtctacgtaccaacgtattccgttattccttacgtcctttaccggtaccctctaacgttctagtac

SEQ ID NO: 142909 - DNA, 805 bp, Homo sapiens
  misc_feature: GYAE6OF02FWDJ0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtcctgcaaccggtgggagacagtcgtaccaccatcctacgttcggccggggactaacggtccggaaactatttacgaaccctaaccgttaattttaaaacgttggttaattccaaaacagttaacggaacccgaagggggaacccggacccccctaagccttacccgttaattcctaatggaccttgactaacgttccctaggttttacgaccggtaaaaggttccgggggtacccctaagtccggtacggtttaccgagggttcgggactagggtcgggtattccgtagggaacctaagtactttacgtacctcgttaccaaccgtactacgtaagttaactctcggtaacctaacggtagtaaacgttacgttttacggtaaccttaaacgtttaatttaccgttacgtaaccttaaacgtaacgttaaactttaaacgtaacgtttacggtttttaacccggaacccggtaaacgggtaccgaaccgttaaacgtaaaaccgttaaaacttaaaacggtaaccttacggtaggttacaccggtacctaacccgttattaccgttaccgttacgtttaccctacgttccccgtttacccgacctaaccgtttacgtagtaacccg

SEQ ID NO: 142910 - DNA, 765 bp, Homo sapiens
  misc_feature: GYAE6OF02JU2C0.46.67.G01.1.454.CMB.1.raw
tcagactagcagtacacgaccggtgctcgatttagagtatacatattgggtttggggagtctcggtcaggacacagcatggacatgaggtccccgctcagctcctggggctcctgctactctggctccgaggtgccagactgtgacagtcgagtctcgacccagtctcctactcctccctgtctcgaccgaaccggtgggacgacgtagtgtccgacctactctacgttcggccgggacgtaacgtccggaactattacgacctaccttaagtttaacgttcggtaactacgtaactagtacgaccgaacgggtaccgtaccgtaacgtccttaccgttaatccttagtcgtcgtactacctacgtacgttacgtacggtacgtaaacggtcgggtacctaggtacggtacgtcgaggtcggtacgtagggtcgtacgtcgggtacgggaacgttacgtacgttactacttaccgtaccgtaacctagtactaaccgggttactccggtagtaaccgtagttacgtaaagttcgttaactacttaacgtttactaacgttgtaaaccgtaagtaacgtttacgtaacgttaacgttccgggttacgtaaccggtacggttaaccaaacggttaacccttaaagtttaaaccgaaacgttaccgttagtaccggttactaccgttaaccggtaccttacgttcgttaccgttccgttaacttccgttacccggttacccttaccggttacgttccgttagtaaccg

SEQ ID NO: 142911 - DNA, 814 bp, Homo sapiens
  misc_feature: GYAE6OF02F6FKF.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtagtggtttcttcgtgggctgggtccgnacgcctccgaggggaacgggctaggaactacagttaggaagttcgtactctacagttaggtggtacggtttccttattacgcgttccgtcttcgtacgaaacggtcgtacgtacgtccgaaacccttattaaccttccttaccggtaggaaccctaccggttacccaacggtactaaaacgttccgttaaccggttttttcccaaggtaaacgtattacgggttaactttcgtacggttaccggtaacccggccgtacggttaccgaaccgggttaccggggtttactttttaaccttacggttcggtacggaacgggtacgtaacgggaccggttacttaagtttaagttagtttaggtttttcgggaaggttttacggtttacgtttaccgtaacccgtaccgttaagtaccggtcggggtaccggggtccgtcccgtacccgggtacggggtacccgtaaggtaaccgttcgtaccggttaccgtacccggttcgttacccgttacgtaccctaccgaccgggaacccggtcccgtacgttccccggttacccgttccccggtcgtacccctaccgttacccaccgtacgccgtaacccg

SEQ ID NO: 142912 - DNA, 876 bp, Homo sapiens
  misc_feature: GYAE6OF02JLB9F.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtcgtccacctagtcacgttggcccgggacaaaggtccggaacatttcgaacctaccttaagttttaaaattggttaactacaaacctaagtacggaaccgaaggggtaccgggacccccttaaaaggcctaaccccgttaaattacccttaagttacggtcctacgtacctaacttacccgtaagttttacggaacctaaaaggggttccggggtcccctaagttccgggtaacggtttaccgaacggtcgggtacgtacggtacgggtattccggtaggggtaacgtaggttaactttaccgaaccttccgtaaccgaacccgtacgttaacgtaacgttaacttccgtacgtaccggtaaacggttagtaacgttaaagtttttccgaactttaaaccgtttaacgtttaccgttacgttaaaaccgtaacgtaaacgtaaactttaacgtaaacgttttacggttttaacccggaacccgggttaaacgggaccgttaaacccgtaaccgtttaaaaaccgttaaaaccgttaaaaaaccggtaccgttacgggttaaccggttactaacccgggttacgtaaacccgttaccgtttaaccggttaccgttttaacccggttaaccctaacggtttccctttaaccccgtaccgttaacctttccgtaacgttacccg

SEQ ID NO: 142913 - DNA, 842 bp, Homo sapiens
  misc_feature: GYAE6OF02G1HBC.46.67.G01.1.454.CMB.1.raw
  modified_base (172)..(172): a, c, t, g, unknown or other
  misc_feature (172)..(172): n is a, c, g, or t
  modified_base (195)..(195): a, c, t, g, unknown or other
  misc_feature (195)..(195): n is a, c, g, or t
  modified_base (366)..(366): a, c, t, g, unknown or other
  misc_feature (366)..(366): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtgtggtttctcgngggctggggtccgcagtcctccggaggggacgggctaggaatacgtagttaggaacgttgtctctacgtagttaggtggtaggttcctattacgagtccgtcttactcgaagcgtacgacgtcacatatctcgtggacacgtcagcaagtctacgttttcccagtaacgtntaggtattcgtaggtcgtacccgtccgtcttacggaaccgtaaccggggtttcgttttaaacgttcgtagttcggacggacggtaacggtaccggtatttaacgtttagttagtttacgggtttttagggtaaggtttacgggttttaacgttttaccgggaaacccgttaaccccgttaagggtaccggttaccgggggtaccgggggttacccttacccgggggtaccccggtaccgggggtaacccggtaaacgggggtaacttacccgggttacgggttaacccgtaccccggtttaccggttaccccgtttaacggtacccccgttaccccgtaaaccggggtaaacccccgggttcccgttaaacccgggttccccggtttaccccccggtttcccccggtaaccgggttccccccgttaaccccgtttcccccggtaaacccggtaacccggtacccgtaaccccccgg

SEQ ID NO: 142914 - DNA, 772 bp, Homo sapiens
  misc_feature: GYAE6OF02GKO8O.46.67.G01.1.454.CMB.1.raw
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggacgaccctgtccctcacctgcgctgtctctggtcgcctcatcagtagtgttctcgtgggctgggtccgcagccgtccgaggggagggctaggaactcgagttggaagtgtctctcagtagtcggtaggtcctatacagtccgtctctacgaagngtcgtgtcaccgatatctcgtggacacgtcagacatctcgttttccagaagtntagtagttcctaggttccgaccggtacccgtcgttacggaaccgtaccggggtttacgttttaacgtttacccgtagggttcggacggtaaccggtaacgggtaccggtacgttaaaggttttcgtaggtttaacgtttttacggggtaacggttttaggggtttaacgttttaccggaaacccttaacccggttagtaaccggtccggggtaaccgggggtccttacccgggtaccccgggttacggggtaccccggtaaggggtaacctttaccggacgggttacccgtacccggttccgttaaccgttaccgtacccgttacccgacccggttaacccgggacctacccgggttcccggttaccccgtttcccccggaccggtccctacccccgttacctacccggtaccgcgttacccccgg

SEQ ID NO: 142915 - DNA, 737 bp, Homo sapiens
  misc_feature: GYAE6OF02G9JDC.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccctttcgggagaccctgtccctcgacctgcgctgtctctggtgcctcatcagtagtggtttcttcgtggggctggggtccgcagcctacccgaggggaagggctggaaactacattggaagtgtcctctcagtagtggacggttcctagttacagtccgtctctcaagagtcgagtacactatactctcgtggactaccgtccagacgaaattcgtaacgtttttcccgagaacgtatggacgtttctggtcgtaccgtcccgctaggacgtacgggttacgttttaactacgttacggtgtacggtagacggtacgtacttagtttacgtaggttagtttttaggaggtttagtttacgttaccgactaaccgttaggtaccgtccggggtaccggggtcgtaccccggtacccggttaccggggaccgtaaacggggtaactaaccggttacggttccccgtacccgttacccgttacctttacccggacccgtttaccccgaaccggaaccggtacccccttaggttaccccgtttccccgtttacccccgtacggtaccccttaccccgttcccgtaacccgtacggtacccgtaacccgg

SEQ ID NO: 142916 - DNA, 653 bp, Homo sapiens
  misc_feature: GYAE6OF02FV30F.46.67.G01.1.454.CMB.1.raw
  modified_base (173)..(173): a, c, t, g, unknown or other
  misc_feature (173)..(173): n is a, c, g, or t
  modified_base (258)..(258): a, c, t, g, unknown or other
  misc_feature (258)..(258): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (557)..(557): a, c, t, g, unknown or other
  misc_feature (557)..(557): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcaccctgcgctgtctcctggtncctccatcagtagtggtttcttcgtgggctgggtccggctagctccccgaggggaacggggctagggaatacagttaggaagttntctctacagtagtggaggttccattacagtccgtctctcaaaggtgtcgagtcaccatactctcgtggacacgtccagcaatctacgtttcccngaatngtattctgtcgaccgccgctgaccgnggtacttttatacgtggtgacgtagacgacggtctaagttactgttacgttttggtagtttcggttaatttccggaacgtaccctaggtactcgggaacggggtcctccggaccccgtggggacccaagggtaactacgtcggtaccgtacccgtcttacccgtacggttcccnccgtaacccgaaccggaccccgtaacgtcccggttacctttcccccggtacggtacccgtaacccccgtcccaacccgtacgtaaccgtaccccgg

SEQ ID NO: 142917 - DNA, 877 bp, Homo sapiens
  misc_feature: GYAE6OF02JH6SS.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcgacctgtggtttgtccctcctgcgtggtggcagcctcccagtatcgggtcctgtccctggtgccaactgcgacggacgtccgggcccacgacgtgggtacgacggtcccttcgggacgtaccccttcggtcccctctaaccgtcgccggtcttggtcctcgttgggtcnccccgttccatccgtaggttacggttcggttttaccttccgggtacgggggtctttcggggcccggcacggtacccttcccggaagggggaacgggtccgtagggtaaactacgtaacggttagggtaacgttcggttccttccgtacgtaaacgttacgggttgggttaaaccggtttcccttaaagtttaaccggtacggttccccggttttacctaccgttaaccgtaaagggttccgtaccggtaccggttacccctaaaccgtacttacgttcccttaccgggtacgggtaaacctcccggttaacccggaagttacccgtaacgtttccgtttaacccggtttttcccgaacggtaaacgtactttacgggtctttacgttacgtaccggtccccggtaccgtcggtacgtaacccggttacggggttaacctttacgtttacgtcggtacggtacgggtacggacggtacgttacttaagtttcgtaggtttacgtttcggtaggtttagttaccgttacgaaccttacccggtagtacggttcggaccggttacgcccggtcccggtcggacgtaggtacctcgtaccgtccgtccgttacgaccctcgaccctaccg

SEQ ID NO: 142918 - DNA, 694 bp, Homo sapiens
  misc_feature: GYAE6OF02H5UM6.46.67.G01.1.454.CMB.1.raw
  modified_base (180)..(180): a, c, t, g, unknown or other
  misc_feature (180)..(180): n is a, c, g, or t
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (354)..(354): a, c, t, g, unknown or other
  misc_feature (354)..(354): n is a, c, g, or t
tcagactagcagtacacgaccggtgctcgatttagagtatacatattgggtttggggagtctcggtcaggacacagcatggacatgagggtccccgctcagctccgtggggctcctgctactctggctcgaggtgccagatggtgacatcgagctgacccagtcctccatcctcctgtcngactaacggtggancagtgcacatcactggccggcaagtcgaactatgacaccttattaatggtatacaatatacgacacgggaccgaccctagctactaatntacgtctncgacatacctagttcgagaacggtcgggtacccagttcgaggttacagtggaccgagtacggntcggtaggacagtattacaccgtctaccacctatacgtaagtaacgtcgtagaccgtaacgttaggtaaactttacggtttaccgaactttaacggtttaaccttacggtttaggtaaacccaaagtaacgttaaaacgttacttaaacggtttccgggttttaaccgaaccgggtaaccgggtaacctaacccgttaactaaaccgttaaaaacgtttaaacggtaacttacggggtacgaccggttaaccgacgttaacccgttattacccgttacgtttacccgtattacccggtttccgtaccccccgtacgtttaaccgtccggttaactaaccg

SEQ ID NO: 142919 - DNA, 878 bp, Homo sapiens
  misc_feature: GYAE6OF02H1WLS.46.67.G01.1.454.CMB.1.raw
  modified_base (188)..(188): a, c, t, g, unknown or other
  misc_feature (188)..(188): n is a, c, g, or t
  modified_base (220)..(220): a, c, t, g, unknown or other
  misc_feature (220)..(220): n is a, c, g, or t
tcagactagcagtacacgaccggtgctcgatttagagtatacatattgggtttgtcctcctgctggtggcagctcccagatgggtcctgtccctgggtgcaactgcgagggacgtccgggcccaacgactgggtcgaggccgttcggacgtacccctgtcccctcaccgtgcgctgtcctcgtggtcncctccatcgtagttacgttggtttccgttcgnggggtcgtcgggtccggcacgccgtaccggaggggacgggctaggaactacgtaagttgggaacgttcgtaccgtctagagttacggtgggtacggttcctatacgtacgttccgtcgtacgtacgaacgtacggtcgaacgtaccaccctatactaccgtcgtacggacctaccgtaccgacgactactacgttaccgttttccgaggtaagtacgttaggtacgttgtccggtaccggtaccgtccccggtgtaacggaccggtttaccgggttacgttttaacgttaccgttacggtcggtacggtaacggtaacgggtaccggtaacgtttaacggtaaggtttcgttttaagggttttacggggtttagttttcgggtttaacgtttaaccggtaaaccgtttacccggttaagtaaccgggttaccggggtacgggtacccggtaccgggttacccccgggtacggggtaccggtaaacgggtaacggttaccgttacggttacccggacccgtttacccgttaccgtaccgtacccgttccggtaaaccccgggtaaccggtacccttagggtacccccggttccccgtttacccccgtcggtacccccgtaacctttaccccggaacccgttaagtacccgtaccccggg

SEQ ID NO: 142920 - DNA, 635 bp, Homo sapiens
  misc_feature: GYAE6OF02GOW9Q.46.67.G01.1.454.CMB.1.raw
  modified_base (148)..(148): a, c, t, g, unknown or other
  misc_feature (148)..(148): n is a, c, g, or t
  modified_base (193)..(193): a, c, t, g, unknown or other
  misc_feature (193)..(193): n is a, c, g, or t
  modified_base (341)..(341): a, c, t, g, unknown or other
  misc_feature (341)..(341): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
tcagactagcagtacacgaccggtgctcgatttagagtatacatattgggtttggggagtctcggtcaggacacagcatggacagtgagggtccccgctcagctccgtggggctcctgctactctggcctccggaggtgccagatgtnacatcgagctgacccagtctccatcctcctgtctgcacggtgganactagtgtcacatctagtcggccgggacaaggtcggaactattcgaactaacttaatttaagtgtatacaacatacgaccgacgggaccgcctaagcctacctaatactatgctgacctataccagtttgacgtaaggtcgggtaccngttcgacgtttcgaggtcggcgtagtcggtatcggtacggacagtattcaacgtctacactanactagtatctnacgtaacgtacgtaagttacgtttagacttaacgtttattacgtacgtaactaactaagttaaacttactaacgtttcggtttacggaaaccgtacggtaacctaacggtaacttaacgtaaaacgttaaaccgtaagtcgtacggtactacgtacccgaacttacgtcgttacgaccttactaaccgttcccgtaaccgtactacttacgtacgttacc

SEQ ID NO: 142921 - DNA, 716 bp, Homo sapiens
  misc_feature: GYAE6OF02GRMFH.46.67.G01.1.454.CMB.1.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtccaccatccacttgccgggacaaggtcggaacattgacaccttatttaaattggtatcaatatagaccagggacggccctaagctcaatctangctgcactactaggtttacacgtaaaggtcgggtcccctagtcggacggtttcaggtcggacgtagtcggtagtacgtaggggaactacggtatttaccaactacctaccaaccgtatactaagttaactacctagaccgaaacggttagtaaaggttactttttacgaaccttaaacttttagttaaccgttagttaaccgaaactaaaggttaactttaaaccgttaaacgtttacgggttttacccggaacggtaaacggggtaacccgtaaacggtaaaccttaaacgtaaaaatttaaaacccgaaacgttaggttagggacctacgtaccgaaaccgttacgttaccggttccgttactttaaccgacggtttccccttttaaccccgacccgtttaactcccggttaggttaacc

SEQ ID NO: 142922 - DNA, 679 bp, Homo sapiens
  misc_feature: GYAE6OF02GWK3E.46.67.G01.1.454.CMB.1.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctgtccctcacctgcgtctgtctcgtggtcncctccatcagtgttggtttctcgnggggctggggtccggncgctcccgaggggagggctggaactacgagttggaatgtctctctagtacgtggacggtttacctagttacgtacgtccgtctctacgaagtacgtcgacgtcaccgtatactctacgtacggacacgtaccagacaattctacggttttaccaggtaagtatggtacgtttctggtcgacccggccgtcgtacggaccgtacgggttcttttaacgtacgttggtacggcggtaacggacggtacgtacttaagtttacgttaggtttagttttttacgggaaggttttcggtttaactttccgaaccttaccgtaagtacgtacgggtacggggcctacccggtacccgggtcgggaccggtaacggtaacttaccggtcgtaccgtacccgtccgtttacccgtaccgtacccgtacccgg

SEQ ID NO: 142923 - DNA, 876 bp, Homo sapiens
  misc_feature: GYAE6OF02IA7QI.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggtcgtcggggtccggcgacgtccgtaccccggaaggggaacggggcgtagggtaactacgagttagggaagttcggtctctcgtagttaggtgggtacggttccttaagttaactaggttccgtccttcgtacgtaaacgtaggttacgtaggtaccaaccgtaattacttcgttacgtagggtacctacccggttccgaacgtctaaaacttccgttaaccgtttttccccgtaggtaaaacgtacgttaggttaacgttcgttaggtacggtaccccggcgtaccggtacggtaaccgtacgggttacgtttttaacgttaccgttgggttcggtaaccggtagggtaaccgggtaccggttaccgtttaaacgtttaaggtttgtttaacggtttttacggggtagggttttaaggtttttaacgtttcccggtaaaacctcccgttaaaggtaccgggttaccgggacgggggttaccccgttacggacccccggggtttggggaacccggtaaccgggttaagttaaccgggtgggttaccccgttaaccgtccgtttacccgtttacgccccgtaaccggacccggaacgggttccctacggttaccccggttcccgttacccccgttacggacccctaccccgtcgtacccgtaaggacccgtaccccgg

SEQ ID NO: 142924 - DNA, 774 bp, Homo sapiens
  misc_feature: GYAE6OF02HOW6D.46.67.G01.1.454.CMB.1.raw
  modified_base (196)..(196): a, c, t, g, unknown or other
  misc_feature (196)..(196): n is a, c, g, or t
  modified_base (414)..(414): a, c, t, g, unknown or other
  misc_feature (414)..(414): n is a, c, g, or t
  modified_base (517)..(517): a, c, t, g, unknown or other
  misc_feature (517)..(517): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtctccatccctccctgtctcgaccacggtgganacagtcgtcaccatcctacgttcggccgggactaaggtaccggaactattacgacctaaccttaatttaaacgttggtaactaccaactacgtacggaccggaacgggaccggacccctaagacctacctaattcgttaacgtcgccgtagtacctacgtaccgtaggtttacgaaccggtaacgggttccgggtaccctagttcggtacggttacgnggtcggactagggtcgacgttcggacggtactacgttacttccaacctcgtaacctacctagtaccgttaagtactcgtacgacgttaacgtagtaacgtttnttacgtaacttaacgttacgttacctacggttaacaacgttaacgtttaacttaacgttaacggtttcgggtttaacccggaaaccggtaaaggtacctaaacccggttaacttaaaaccgttaaaaccgtaaacggttacggtacgttaccgggtacgttaccggtaccctaaacgttctttaaccgggttacccgtttacttacccgttaccgtttacccggttaccccgtaacgttccttacgtaaccgttacg

SEQ ID NO: 142925 - DNA, 728 bp, Homo sapiens
  misc_feature: GYAE6OF02HUM90.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccacgtcctccctgtctgaccaaccggtgggacgacgagtgtaccacctaatcgacgttcggaccggcgtaaaggtacggtaactagttacgacctaaccttaagtttaaattggtaacttacaactaacgtacgaaccgtaacgggaccgaccccgtaacgacctaccgtaaatcgtaacgtgtacctgtacctaacgtacccgttaggttacgacgtaaaggttccggggtaccctaaggtacggtaggttacgtaggtacggacgtaggtacgtactcggttacgggtaactaagttaacgttcccaacgtccctacctacctataacgtaacttaacgttcgaaacgtacgaaacgttaggtaaagttctttaacgacttaacgtttacttaacgtataacccgaagtaactaaactttacgaacgttttacggttaccgaacggtaacgaacgtaccgaacttaaacgtaaaaccgttacgaacgttaggacgtacctcgaaccgtaactatcttacgttactaccgtactaccgttacccacgtacttatacgtaacg

SEQ ID NO: 142926 - DNA, 682 bp, Homo sapiens
  misc_feature: GYAE6OF02GOYA7.46.67.G01.1.454.CMB.1.raw
  modified_base (254)..(254): a, c, t, g, unknown or other
  misc_feature (254)..(254): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtgcctccatcagtagtggtttcttcgtgggctgggtccggcagcctccgaggggagggctggaatacagttggaagtgtctctnagtaggtggtacggttcctattacgagttccgtctctacgaagtagtcgagtccaccatactctcgtcggaacctaccgtccgacgacaatcttacgttttcccagaagtatgtagttcgtcggtcgtaccgccgacgtcgaccggtacgggttaccgttttaacttacgttggtcggcggtaaggacggtacggtactttaagttagttaggtttagtttttgggagtttggtttaactttccgaaccgtaccgtagacgttcgggacggggtccgtcccggtaccccggtgggtccgaagggtaccgttacgtacggtcccgtaccgtccgttccgttacgcccctaccgaacccgccgggtacctaccggtcccgttcccgttaccccgtcgtaccctacccccgtcctaccgacgcgtaccccg

SEQ ID NO: 142927 - DNA, 613 bp, Homo sapiens
  misc_feature: GYAE6OF02IYM4U.46.67.G01.1.454.CMB.1.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
  modified_base (477)..(477): a, c, t, g, unknown or other
  misc_feature (477)..(477): n is a, c, g, or t
  modified_base (602)..(602): a, c, t, g, unknown or other
  misc_feature (602)..(602): n is a, c, g, or t
tcagactagcagtacacgaccggtgctcgatttagagtatacatattgggttttgggggagtctcgggttcaggacacgagcgatggacatgagggtccccgctcagcctccgtggggctcctgtcctactctggcctccgaggtgccagatggtgacagtccgagcgtgacccagtctccatcctccctgtctgcaaccgtggagacagtgtcaccatcacgttgccgggnaacggtcggaacngttgacctaccttatttaaattggtacttcaacgtatacgaaccgagggaccggacccctaagctccgtaatccgtatgacctgcctatcctagtttagccaaaggtcgggtcccagtcgaggttcgagttggcaggtcggtatcgtggacngtacttcactctcactacgctatatcncgtacaacgtgtaacgtntttcacgtaacttntactgtacaagacgtaattanaacttggtttacggaccgtaagggaccgtaaactacgtaaacgttaaagttaaacgtaaacgttggtacgtatcgtacctaccgtattcggttattacccttgtaacttcccgttccaaccgttnttacgttacac

SEQ ID NO: 142928 - DNA, 737 bp, Homo sapiens
  misc_feature: GYAE6OF02H4UKL.46.67.G01.1.454.CMB.1.raw
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctccctgtcngacaccggtgganacgagtcgcaccatcacgttcgccgganaagtcggaactattcgacctaacttaattttaaagttaggtaacttaccgaaactaacgtaacggaccggaacggggaacccggtaccccctaaagccgttaccttaaattaccgttaatcggtcctacggacctaacgttcccgttaaggttttacgaaccgttaaaaggggttcccgggtacccctaaggttacggtaacggttacgtagggtcggcgtaagggtagtacgtacgacgggaactacgttactttccaacttcacctaaccattacgtaaagttactccgtagtacgtaaacggtagtaagtttctttacaacgttaaccttttagttacaagttaaccaaagttattaaacgtaacttaagtttacggtttccgaaacgtaacgggtaacctaaccgtaaacttaaaccgttaaaataaccggtaatcgggtaccgtactaccgacctaacttctcgttaacgttactacttccttccgtaccctataacgtcgtacgtaacg

SEQ ID NO: 142929 - DNA, 660 bp, Homo sapiens
  misc_feature: GYAE6OF02GDMOH.46.67.G01.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (321)..(321): a, c, t, g, unknown or other
  misc_feature (321)..(321): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtncctcatcagtagttgtttcttcgtggggctcgggtccgnacgccgtccgagggagggctaggaatacgagttggagtgtctctcatggtggtacggttacctattacgngtaccgtctctgaagtacgtcgacgtacaactatacttctcgtacggacaccgtcagactaacttcgttacgtttcccagtaacgtatacgtacgtttccgtaggcgacccgtccgtcgtacgacgtacggtttcgttttacttacgtgtcgcggtaacggacggtacgtactttagtttagttcgtttaagttttgggtagttttcgtttacgtttaccgacctaccgtagtacggtaccgggacggggtccgtcccgggtacccgggtacgggacccggtaagggtaccttacggtcgtcccggttacctccgtacccgttccgtacccgtaccccg

SEQ ID NO: 142930 - DNA, 636 bp, Homo sapiens
  misc_feature: GYAE6OF02I04CE.46.67.G01.1.454.CMB.1.raw
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (409)..(409): a, c, t, g, unknown or other
  misc_feature (409)..(409): n is a, c, g, or t
  modified_base (476)..(476): a, c, t, g, unknown or other
  misc_feature (476)..(476): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctcatcctccctgtctgcacgtgganacngtntcacatcacgttggccggacaaggtcggaaactgttagacctaccttaattttaaagttggtaatacgaaacagtacgaaccgaacggggaccggcccctaagtcctacctaagttctaatcggtctgcctagtaccttaggttacgacgtaaacggtcgggtaccctagtcggtagttcgtaggtcggcgtagtcgtactgtacgggatagtnttacgactcgactacgtactagtagtatacgtcgaacgtagtagtagttactttcgaactaacgttnttaaccgttatactaactacgttaataccttaggtttacgttacgaccgaacggtaacctacgtaacttaaagtaaacttaacgagttgacctagtacgactaccggtatacgttcgttattaccacttccccgttacgttacgacttccgtagttaccg

SEQ ID NO: 142931 - DNA, 757 bp, Homo sapiens
  misc_feature: GYAE6OF02I7ILB.46.67.G01.1.454.CMB.1.raw
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (329)..(329): a, c, t, g, unknown or other
  misc_feature (329)..(329): n is a, c, g, or t
  modified_base (556)..(556): a, c, t, g, unknown or other
  misc_feature (556)..(556): n is a, c, g, or t
  modified_base (584)..(584): a, c, t, g, unknown or other
  misc_feature (584)..(584): n is a, c, g, or t
tcagactagcagtacacgaccggtgctcgatttagagtatacatattgggtttgggggacctcctgtgcaagaacatgaagcacctgtggtttgtcctcctgctggtggcagctccagatcgggtcctgtcctggtgcaactgcaggacgtcgggcccacgacgtggtcgaggtccgttacggacgacccctggtacccctcgacctgcgtctgtcctcgtgggtcnccctacatcgaggttagttcggtttcttcggnggggtaccttcggggaccgnaccgtccgtccggtaaggggaacgggctaggaatacgagtttggaacgtntcctatacaggttaggtacgtacggttacctaacgttacgtacgtccgttctacgtaccgaaaggtcgtcgtaacgtcctaacctagtacctcctacgtacggaactaccgagaacggtactaaacgttcgtttaaccgttacgacgggtaaatacggtctaacggtttcgcggtaaacggaccccgtagttcgaaggtaaccgtacgggttattttaaccgaggtnacggtacgagtacggtatactagttacnggtttaagtttcgtagtaacgtttacgtaccgaacttaccggaggttaacgtcccggggttacgacggttacccccggtaacgcgggggttaaaccggaaactttaccggtaacgtttacccggggaacttaccccggttacccgtttaacgttcccgtaacccctaacgggg

SEQ ID NO: 142932 - DNA, 650 bp, Homo sapiens
  misc_feature: GYAE6OF02IG8GU.46.67.G01.1.454.CMB.1.raw
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctcatcctcctgtctgcacgtggacacagtntcaccatcacttgccggnaagtcgaatntgactactattaatgtatcaantagaccgagggaccgcccctagctactatctatgctgcatcagtttnacgtagtcggtccagtcgagttcagtgcagtgagtcgtgacgtagtactttcgactctacccgtactataccgaagttacgtccgttagccgtaaacgttgtaaacgttacgttttacggaccttaactttacgttaccgttaacggttaaccaaacggttaattaaaccgtttaacgtaacgtttttacggtttacccggtaacggtaaccggtaaacgttaaccgtaaccgttaaacgttaaaaacctaaacggttaacgttacggtacgtacgttacgtaacgtaacctactttacggttactttaaccgttttacttacccgttcccgttacctaccgtttactccgtaaggttac

SEQ ID NO: 142933 - DNA, 660 bp, Homo sapiens
  misc_feature: GYAE6OF02H98JX.46.67.G01.1.454.CMB.1.raw
  modified_base (295)..(295): a, c, t, g, unknown or other
  misc_feature (295)..(295): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagacccctgtccctcacctgcgctgtctctggtcgcctccatccagtagttggtttctcgtgggctgggtccggcagcctccgaggggacgggctaggaatacgattagggaagtgtcctctcagtagtggaggtttcctatacagtcagtctctnaagtagtcgatcaacctatatctcgtggacacgtccagacaatcgtctttacccagtaacgatagtattctacgtcgacccgccgctagaccgacggttacgtttactacgtgtacgacgtagacgaccgtattattagttgtttagtttaggaggtttagggtttaatttccgtaaaccgtacttaacggtacgttacgggtaccggggtccgttacccggacccgggtacggggtaccgaacgggtagttaccgttacgggacccttaaccggtccttaccgttaccacccgtaccccgaaccgaccggtacctaccgttccggtcccttcccgtcgacccctaccgtccctaccgactaccg

SEQ ID NO: 142934 - DNA, 727 bp, Homo sapiens
  misc_feature: GYAE6OF02G8IVX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaacggtgggacgacagtcgtcaccatcacgttcggccgggacaagtacggaaactagttacgaccgtaaccttaattttaaagttggtaactaccgaaactaagtaacgaacccggaacggggacccggtacccccgtaagaccttacctaacttactagtcggtctagacctacgtaccgtagtttcgaacgtaacggtcgggtacccagtacggtacgtcgaggtacggcgtagtaggagtcggtagggactagtactttacgtacgttcaccgtactactactaagttaactcgtaacggacgtaacgtagtaaacgttagttttaacgtaactttacgttacttaacgtaactaaagtaacgttaaactttaacgtacggttttaacggtttaccggaaaccggtaaacgggtacctaacggttaactaaactaaaacgttaaacgtacgttacgcgtactacgtaacctactacgttacctcgttaccttaccgtaccgtttacccgtaccgttactaccgttagttaccgtattaccgg

SEQ ID NO: 142935 - DNA, 858 bp, Homo sapiens
  misc_feature: GYAE6OF02JE7XV.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtcccctcacctgcgctgtcctcgtggtcgcctccatcagtagttggtttcttcggtggggtctcggggtccgcgacgtccgtacccgagggggtacgggccgttaggaaataccgtagttagggaacggttggtcttaccgtactagttagggtagggtacggtttacccttaacgtttaaccgaccggttcccgttaccgttacccgtacgtaaacggtaccggttccggtaacggtaccaacccgttagttaaccgttcttacggtaacggtaacccgtaccggttaccctaacggacttaaacgttaccgtttaacccggtttttaccccgtaagggtaaacgtaggtttaaccgttaacggttttacgtccggtacggtaaccccggtccggtacgtacggtaaccggtaacccggggtttaaccgttttaacgtttaccggtttggtaccggtacggtaacggtaccgggtaccgttaccgtttaacgtttagtttagggtttaacggttttttaggggtacgtttttagggttttacgtttaccgtaaccgtacccgttagtaccgttacggggtacgggtcccgtcccggtacccggtcgggtaaccgtacggtaacgttacgtacggttccaccggttccgtccgttaccgtcccctacccgg

SEQ ID NO: 142936 - DNA, 760 bp, Homo sapiens
  misc_feature: GYAE6OF02HUY09.46.67.G01.1.454.CMB.1.raw
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (315)..(315): a, c, t, g, unknown or other
  misc_feature (315)..(315): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccagtcctcctactccttcccgtntcgcgcaacggtggganacngtcgtcaccntacgtctcggccgggnaaggtacggaatattcgactacttaatttaagttggtatacgaactatacgaacggacggaccggaccaactccgtactaatctagtcncgtcacgtactacgtagttcgaacgtaacgggttacgggtaccctaggtccggttaacggtaccgtagggttaggaccggtaaggtggaacgttacggagggaaccgtaagtaccgttacacttaccaaccgtacaacttacgtaacgttaatccgtacgactaaacggtagtaagttacgttacgtaacttaaacgtttagttaacctacgtttaacaaaaccgtttaaagaaaccttttaacggaaacgtttacggtttaaccggtaaaccggtaacggtaccgtaaaccgtaaccggttaaaactaaaaccgtttaaaacggtaacgttacgggtaccgaacccggttcgaacctaaccgttaacctccggtttaaccgtaaccgtttcgttaacccctttccggttaaacccccgtagttacccgttagttaccttaaccg

SEQ ID NO: 142937 - DNA, 895 bp, Homo sapiens
  misc_feature: GYAE6OF02HNLSX.46.67.G01.1.454.CMB.1.raw
tcagactagcagtacacgaccggtgctcgatttagagtatacatattgggtttgtcctcctgccctggtggcagctcccagatgggtcctgtccctggtgcaactgcaggagtcgggcccacgactggtgaggccttcggagaccctgtccctcacctgcgctgtctctggtcgcctcatcgagttagttcggttttcttcggtcgggggtcgttcggggtaccggcgacgtccgtacccggaagggggtaacgggggtcgtaggaacttaacgtaggttagggaaggttcgtccttcgtctagttacggtggtacgtttctagttacgtacgttccgtctctacgaaggtacgtacgtacgtaccaaccgtatacttcctacggtacgacctaccgtacaacgactaatcgttacgtttaccgtaagtaacgtatacggtttacgttcgtacgtaccggtacccgtaccggtcgtaacggtaccgggtaaccgggttttacgttttaacgtttacgttcgggtaacgtacggggtaaggaaaccgggttacggttaacttttaaggtttaacggtttaggttttagggtttttaacggggtaggtttttaacgggttttaactttaacccggtaaaccggttaacccgtttaaacgggaccgttaccgggggggtaaccggtccccggttaccccggggttaacccgggacccggggtaacggtaaaccgggtaccgttcgggttaccgtacccggttcccgttacccgttacccgttaccgaccccggtaaccgtaacccggggtaaccgtcccggttaaccggttccccgtttccccggtacccgtaccggtacccctacccgttaccgaaccgtacgtaccccgtacccgg

SEQ ID NO: 142938 - DNA, 608 bp, Homo sapiens
  misc_feature: GYAE6OF02I1MAD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctaatttaaattgtatcaacatagaccgagggaccgcccctaagctactaatctatgctgcatccagtttgacaaaggtcgggtccccagtcggtagttcgaagtggcgtagtggtactcgtaggactagtactttacacttcctaccaacctacttactaaggtaactcgtagactaacggtagtaaagttatttcgaacctaactttaattactagtacaagtaagtaattactaagttcgtttaccgacggaaggtacaacgtacttaactaaaattaacggaaacgtgtacgtctacggactaaccttagtccttaggttacctttaccgtacgtttcccgttaacccgtcctaacttccgtattaacg

SEQ ID NO: 142939 - DNA, 742 bp, Homo sapiens
  misc_feature: GYAE6OF02GVZS6.46.67.G01.1.454.CMB.1.raw
  modified_base (101)..(101): a, c, t, g, unknown or other
  misc_feature (101)..(101): n is a, c, g, or t
tcagactagcagtacacgaccggtgctcgatttagagtatacatattgggtttggggagtctcggtcaggacacagcatggacatgagggtccccgctcanctcctggggctcctgctactctggctccgaggtgccagatgtgacatcgagctgacccagtctccatcctcctgtctgcaaccggtgggagacagtcgtacaccatcacgttcgccgggcaacggtcggaaacattacgacctaaccttaattttaaagttggtaacttacgaactagtacgaaccgacggggaccggtcccctaagccttaccgtaatctatcgactgctacttcgtagtttagacgtaaacggttcgggtaccctagtacggtaggttcaggtcggactaggttaggacttcggtagggactacggtactttccgacttccgtacctacgtacttaccgtaagttactcgtacggaacctaacggttaggtaaactttgtttacgtaaccttaaacttttacgttaacttacgttaaacgaacgtaacgttaaatttaaccgtaaacggttttcggttaccggaaccgtaaacgggtacaaacgttaacgttaaacttaaaccggttaaacgtaacgttcggacgttactacggtaacccgttcgttaacgttccgttaaccgttaacctttcctaacccggtttaccccgtttaccccgacgtttaaccgtttccgtatttaacccgg

SEQ ID NO: 142940 - DNA, 803 bp, Homo sapiens
  misc_feature: GYAE6OF02IUY1O.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcacatcattggccggganaagtcgaacnttacgactacttaatttaagtgtatacaanagtacgaccgagggaccgtccctaagcctactatctangctagctactctagttcgagtaacgggtcggtaccagtcggtagtcgagtacggcgtaggtacgtacgtcggttacgggaactacggttactttaccgaacgttcctacgtaaccgtaccttaacgtaacgttacgtcggtaaccgtaaccgtaacggttaagggtaaacttttacggtttaacctaaccgtttaaacttttacggtttaacgttaccggttaaacctaaaacggttaagtttaaacgttttaaaaccgttaacgggttttacccggttttaaccggtaaacgggtaaaaccgggtaaaccgttaaacccggttaaaaccttaaaaacgggtttaaaaaactttaaacccgggttaacggtttaagtccgggttaacccgaaccggtttaaccggtaaccccgtttagttaacccgtttaaccgttttaccggttaacctttacccggttaaccccggtttacccgtaccgtaaacgtttttccgaacgtttaaccgg

SEQ ID NO: 142941 - DNA, 772 bp, Homo sapiens
  misc_feature: GYAE6OF02G8XK2.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattgggtttggggaggtctcggtcaggacacagcatggacatgaggtccccgctcagctcctggggctcctgctactctggctccggaggtgccagatgtgacatcgagctgacccagtcctccatccctcctgtctacgcctaaccggtgggaacgacagttcgtaccaccactctacttcgggcccggganaaggtccgggaaactgttacgaaccttacctaagttttaaagtggttaactactaacacgtaacggaaccgaaggggaccgacccccgtaagtacccttaacctaacttaccgttaagtcgtactacggacctacgtacccggtaagtttcggtaaacgtaacggggttaccggggtacccctacgttcgggtaaccggttcgaaggttcggggaacgttaggcggttaagtccggttagggaaccgaagttacgttccttaacgtcctaccgtacctagtctaaacgtactgttaacgaaccgtaaggtagtaaagttactttacgaacgttaacgttacctttataacgtacctaaacgtagtaaacttacgtaaacgtttcggtttaccggaacggtacgaaccgtaccgaaacttaacgttaaaacgttaaacgtacgttacgtacgggtactaccggtaccgtaactaccgttacctttagtacgttacgtacgttaccccgttacccgtaactacgtttcattaaccgg

SEQ ID NO: 142942 - DNA, 621 bp, Homo sapiens
  misc_feature: GYAE6OF02H2SQK.46.67.G01.1.454.CMB.1.raw
  modified_base (97)..(97): a, c, t, g, unknown or other
  misc_feature (97)..(97): n is a, c, g, or t
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgntcagctcctggggctcctgctactctggctcgaggtgccagatgtgacatcgagctcgacccagtctccatccctcctgtctgccaaccggtgggagacgagtcgtccaaccattccacttcgggccgggtactaaggtccggaaacagttgaacctaaccttaattttaaagttggtatacctaaacagtaacgaccgaacgggtaccggacccctaaggcctaccgtaatctatcgacttgacctataccttagtttacgacgtaaacgggttccggacctagttcggtacggttcaggtggacgtagtggatcggtaggactagtactttcacttcacacatacgtagtacttgtcacgtaagtagtattctttagactagtttntacgatacaatagttaactatacgtttcgtacggacacgggtactacgtaactaataaacgtaacgacttgacgtacgtccacgtactaattcgtacttactcctacgttacccgtcgtacctactacgtataccg

SEQ ID NO: 142943 - DNA, 620 bp, Homo sapiens
  misc_feature: GYAE6OF02FKUVP.46.67.G01.1.454.CMB.1.raw
  modified_base (304)..(304): a, c, t, g, unknown or other
  misc_feature (304)..(304): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccaggatgtgacatcgtagctgacccagtactccatcctccctgtctgcaaccggtgggagacagtgtcaccgatcacttgccgggcaaggtcggaacattgacacctatttaaagtggtatcaacatagaccgaggtacggcccctaagctcctaatctatgctgcntccagtttgcaaaggtcgggtccagtcgtaggttcagtggcaggtggatacgtgggaacaggtacttcgactcgtcaccgatcagttaatcgtacgacaacgtcgaatattttcgactaacgttattacgttacgtactaaacaacgtaaacttactaaacgttggttttaccggaactaaaggggtaacctaacggtaaacttaaactaaaacgttaaaacgaacgttacgggtagaccgtacggtaccgtaacctaacgttctaacgtccgtttacgacgtttccgttaacccgaccgtaacttcctggttaac

SEQ ID NO: 142944 - DNA, 702 bp, Homo sapiens
  misc_feature: GYAE6OF02HBQOF.46.67.G01.1.454.CMB.1.raw
  modified_base (201)..(201): a, c, t, g, unknown or other
  misc_feature (201)..(201): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctcgacccagtcctccactccctccctgtctgaccgaacggtggganacgagtgtaccacatcacgttgccgggacaaggtacggaaactattacgaacctactttaaagttttaataggtaactacaaactataacgaacgaacgggacccggacccctaagccttacctaatctactgactgacactcctagttacgacgtaagggtccggtaccagttaccgaggttcgaggtcgntaggtacgagtacgtagggaactagttactttacacgttccacgaacctagtacgtaataactcctaacggacgtaaacgtagtaaagttacgttttacgaacctttaaacttcgttaacgttactaacgtaaacaaggttaaaccttaaatacgtttacggttacccgggaacaaacgggtacctaaacgttaacctaaaattaaaaccggttaaaacgtacgtagttcggtacgtccgacctaaacctactaccggttcttaccgttactaccgtttcccacccgttacagtttaccgtacgtaacg

SEQ ID NO: 142945 - DNA, 650 bp, Homo sapiens
  misc_feature: GYAE6OF02G37XF.46.67.G01.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttggggagtctcggtcaggacacagcatggacatgaggtccccgctcagctcctggggctcctgctactctggctccgaggtgccagatgtgacatcgagctgacccagtctccatcctccctgtctgcaaccgtggganacagtgtcaccatcacttgccggcaagtcggaacnttgacacctatttaatgtatacaanatagacagggacgcccctaagctacctaatctatgctgcatcctagtttcgacgtaaacgtcgggtcccagtcgaggttcagtcgcagtgntcgtagggacagtatttcactcncacctatactagtatctagacaacgtggaaattagttttcgaacttaaactttacttacgttgtaacctaaacgtagtaaactttaactaaagtttcggttttaaccggaaccggtaacgggtaaccgtaaccgtaacttaaaccgtaaaaagttttaaaaacccgacgttaacggtacggtactaacgtaacccgtaaccgttaaccttacggttaacgttaccgtttaccgtacctttaccccggttaccccgtacctttaacgttacccttacggttaaacc

SEQ ID NO: 142946 - DNA, 747 bp, Homo sapiens
  misc_feature: GYAE6OF02GTRL2.46.67.G01.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (530)..(530): a, c, t, g, unknown or other
  misc_feature (530)..(530): n is a, c, g, or t
tcagactagcagtacacgaccggtgctcgatttagagtatacatattgggtttggggagtctcggtcaggacacagcatggacatgagggtccccgctcagctcctggggctcctgctactctggcctcgaggtgccagatgtgacatcgagctcgacccagtcctccacttccctccctgtctgaccgaaccggtggganacngtcgtccaccgtatcacttcggcccggganaacggtaccggaanttacgacctaccgtttatttaaagttggtaatccaaactactacggaacctagggaccggaccccctaaaggtcctaccttaattaccgtatggctcggactacgtcctaggttacacggtaacggtcgggtaccctagtcgtacggttcacggtggactcggtaggtcgtcggtacgggtaactagtactttaccgtacccgtacttacccactacttaacgtacgtttactacgtacgtaacgtaacggtagtaaacgttagttccaacgtttaaccttnttaaccgttacgtaacctaactaacggtttaaacttaggttaaaccgttcggtttaccggaccgtaaacggtaccgtaaagaacccttaaattaaaacgtaaacggttagtacgtacggttacctcggtaacccgttacgtacctttcggttaccttaaccgttccgtttaccgtccccctttaaccgggcccttttaaccttcgttaaacgttccg

SEQ ID NO: 142947 - DNA, 792 bp, Homo sapiens
  misc_feature: GYAE6OF02IMV0V.46.67.G01.1.454.CMB.1.raw
  modified_base (277)..(277): a, c, t, g, unknown or other
  misc_feature (277)..(277): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccgtcctccctgtctgcaaccggtgggagacagtgtcaccatcacttcggccggacaaggtcggaactattcggaacctaccttattttaaaagttggtaatacaaactanagaaccgagggaccggaccctaagtctacctaatcgtaatcgactcgactacgtacctagtttcgaacgtaaagggtccggggttcccaagttcggtaacggttcgtaaggtcggacaaggtgtaactcggtacggggtaacaggttaactttcgtacctacgttaccacctaagtaccgtaagttaactaccgtaccgtaactaaacgggttacgaaacggtttaacttttcgtaaacgttaacctttaatttacgtacggttaaactaaacgtaaagttaaccttaagttaaacgtttcgggttttaacccgggaaccaaagggggtacctaaaaccggttaactaaaaccgttaaaacggtttaaacccggtaaacttcgggttaacggtaccgtttacgacccgtaacccgttaacgttaccggttacgtttaacccttaacctaccctttttacccgggtaacccccgttaccttacccgtttaacgttaccgggtaaactttaacccgg

SEQ ID NO: 142948 - DNA, 739 bp, Homo sapiens
  misc_feature: GYAE6OF02JULE2.46.67.G01.1.454.CMB.1.raw
  modified_base (165)..(165): a, c, t, g, unknown or other
  misc_feature (165)..(165): n is a, c, g, or t
  modified_base (381)..(381): a, c, t, g, unknown or other
  misc_feature (381)..(381): n is a, c, g, or t
  modified_base (717)..(717): a, c, t, g, unknown or other
  misc_feature (717)..(717): n is a, c, g, or t
tcagactagcagtacacgaccggtgctcgatttagagtatacatattgggtttggggtagtctcggtcaggacacagcatggacatgagggtcccgctcagctcctggggctcctgctactctggctcgacggtgccagatgtgactatcgagctgacccagtcnccactccctccctgtctcgacaaccggttgggacgtacagtcgtcaccgaatctacgttcgccggggacaaggtccggaactaattcgactacctaattttaaagttcggtaatcaacactaacgtaccgagggaccggtacccctaaaggcctaacgtacttactactcgctacgactactacgttacgttcgtagaaacggtttgggtaacccncggtacgttacggttaccgaaggtttcggaaccgtggttaccgggattacggtacggggataacgggttctttactaacccttgttaccacctatacgtaacgttaactctagtaaccgtaacgtaacggtaattacggttactaaccttaagtttaactacgttacgttaacaacgtacgttaaacttaactagtttacgtttaccgtaacggaacgtaaccgtaacgtaaccgttaaactaaacggtaaaccttaaggtacgttaacggtacctacgaacccttaaccggaattccggttacgtttaccgtaacgttacttacctaccccggtntttaacggtacctacgttaacg

SEQ ID NO: 142949 - DNA, 708 bp, Homo sapiens
  misc_feature: GYAE6OF02GYLAG.46.67.G01.1.454.CMB.1.raw
  modified_base (212)..(212): a, c, t, g, unknown or other
  misc_feature (212)..(212): n is a, c, g, or t
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtagtggtttcttcgtgggctgggtccggnagcctcccgaggggaagggctaggaactacgagttggaagttgtctctcgatagtggtaggttccttattacagttccgtctctacaagngtcgagtccaacctatatctcgtgaccacgtccagctaatctacgttttccagaatntagtacgttctgtccgacccgccgtctacggtacgtaccgggttagttttacgttcgtgggtacgtacggtaaggacgtacggtactttattacgttggtttagttttgggtaggtttgtttacgttacgtacctaccgttagtacgtccgggacgggtccgtacccgtacccggtacgggtaccgtaacgggtaacgttaccgtcggtaccgtacccgttccgttaccgttaccctcccgtacccgtaaccggtaacccgggtaccccttaccggttcccggtttccccgtttcccccggtcgtacccccgtaccccgttaccccgtacccgaacgtcccggtacccg

SEQ ID NO: 142950 - DNA, 686 bp, Homo sapiens
  misc_feature: GYAE6OF02HTZAG.46.67.G01.1.454.CMB.1.raw
  modified_base (172)..(172): a, c, t, g, unknown or other
  misc_feature (172)..(172): n is a, c, g, or t
  modified_base (270)..(270): a, c, t, g, unknown or other
  misc_feature (270)..(270): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatcgggtcctgtccctggtgcaactgcaggagtcggcccacgactggtcgaggcctttggagaccctgtccctcacctgcgctgtctctggtncctcatcagtacgtggtttctcgtgggctgggtccgcagctccagggaggctggatacattgaatgtctatcagtagtggacggtttcctagtttacnggttccgtctactcaaagcgttcgaagttccaactattactctactggacacgtccagcctaatctacggttttacccnggaatacttgacgttctggtacgacccgcggtcttcggaacgtcggggttaccttttaatccgttggtacggtccgtaagggacgtaccggtacgtttaagttagttggttaagtttttacgggagtttcggtttagttaccggtacctacccgtagtacgtacgggaccggggtacctccgtaccccggtacggggtaccgaagggtaacgttaccgtcggttacccgaccgttaccgttccttacgcccttaccgaacccggtaaccggccctacgtcccgttacccttccccgttcggtaccctaccgttaccctacccgttacccaagtcccg

SEQ ID NO: 142951 - DNA, 825 bp, Homo sapiens
  misc_feature: GYAE6OF02ICKSE.46.67.G01.1.454.CMB.1.raw
  modified_base (140)..(140): a, c, t, g, unknown or other
  misc_feature (140)..(140): n is a, c, g, or t
  modified_base (152)..(152): a, c, t, g, unknown or other
  misc_feature (152)..(152): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgganaccctgtccctnacctgcgctgtctctggtcgcctcatcagtacgtgtttcttcgtgggactcgggcgcagcctaccggaaggggagggctaggaatacgtagttggaagtgtctactctaagtcggtggtacggttacttagtacgagtccgtctcgtacaaggtgtacgacgtacacctaagttactcgtcgagacctacgtacacgtacacgttacgttaccgttttacgaacgtaagtagtaacggtgttacgtacgtacgacccgtcgtacgtcggtaaccggtacgggttactttaacgttcggtaggtcgacgggagtacgggtacgtacgttaagttacgttaggtttaggtttacgggtaacggtttacggttttacgtttaacccgaaacccgtttaccgtaacggggttacggttacccggggtaccgggggtacctcccggggttaaacccccgggtagggggtaacccggtaaggggtaaccgttaccgggttaccgggtttacccgtacccggtttaaccgttacccgtttaaccgggtaccccgttaacccggtaacccgggtaccggtaaccccgttaccggttcccgggtttaacccccgttcccccgtaccgggtaccccccttacccggttaacccgtaaccgtaacccggtacccgtaaccccgg

SEQ ID NO: 142952 - DNA, 837 bp, Homo sapiens
  misc_feature: GYAE6OF02JRLOL.46.67.G01.1.454.CMB.1.raw
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttgtcctcctgctggtggcagctcccagatgggtcctgtccctggtgcaactgctaggagtccggcccacgactggtcgaggcccttggactaccctgtccctcacctgcgctgtctctggtcncctcatcagtagttggttctcgtgggctgggtccgncgctccgaggggaggtctaggaactactagttgggaacttcgtcctacagtacgtaggtacggtacgttcctagttaccacgtccgtctcgtactaaggacgttcggaactccgaactattacgtactcgtacggaacctccggtaccacgtactaacttccgttaccgttttcccagtaaaagtctacggttacgttcgttagtacccggaccgttaccggtactacgggtaaccggttaggtttacccgtttaaggttaccctagggtcgaacggggtacggtaccggtaaccgggttacctttaaaggttaccggtttggttttaaacggttttaacgggttacggggtttaaacgggtttttacccttaacgggtaaacccccgttaaccggttagggtaacccgggttacccgggggttaccggggtaccccttacccggggtacccgggttaccggggaaacggttaacggggtaaaccttacgggttaccgtaacccggttaccgtaccgttccgtacgacccctaccggtaccggtaacccggtcaaccgtttcccggtaccccgttcccgtaccggttaccctaccccgttacccgacggttaccacggtaccccgg

SEQ ID NO: 142953 - DNA, 616 bp, Homo sapiens
  misc_feature: GYAE6OF02JIX5A.46.67.G01.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (465)..(465): a, c, t, g, unknown or other
  misc_feature (465)..(465): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaccggtgganacagtgtcaccatcacttgccgggcaagtcgacntgacactattaatgtatcaanatacgacaggcgaccctagctactaatctatgctgcactcgtagtttcgacgtaacggtcgggtaccctagtcggtaggttcgacgtcggacgtaggtacggtagtcgtagggacagttactttcaacgtcctaacacgtacgtctaacggtatcgtagtacgtaacgtgtaagttatttacagtaactttatacgtacgtacaaacgtattaacgttanagtttcgttaacgacgaacggtactaaccgtaacgtaacttaaaacgtacgtaacgtagttcgtactacggaccctaacgtaacgttccgttacttaccgtttactacccgtttccctaccccgtacgttacgttaccgttacttaaccgg

SEQ ID NO: 142954 - DNA, 762 bp, Homo sapiens
  misc_feature: GYAE6OF02GGGH7.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctcccgagggagggctaggaatacgattgggaagtcgtctcgtctagtaggtggtacggttcctaagttacgacggtcccgtctctacgaagtacgtcggatccacctagttactctacgtaggaacctacgtccaagacctaattccgttacgttttacccgagaacgtagtgtacgttcgtgtcgacccgccgtctcggaacctacgggttacgttttaactacgtggtacgtacgaagacggtacggtactttaacgtagtcggttaagttttacgggaggttttacgggtttactttaccgtaaccgttaacccgtaggttaccgtaccggggtaaccggggtccgtttaccccggtaccccgggttacggggtacccggtaacggggttaaccttccggtttaccgggtaccctacccggttccttaccgttaccgtcccttacccgtaaccggaaccggttccccgtaagttccccggttacccgtttccccggtacggtaccccgtacccccgttccgtaacccggtaccgtacgtaaccccgg

SEQ ID NO: 142955 - DNA, 748 bp, Homo sapiens
  misc_feature: GYAE6OF02F1U5Y.46.67.G01.1.454.CMB.1.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (608)..(608): a, c, t, g, unknown or other
  misc_feature (608)..(608): n is a, c, g, or t
tcagactagcagtacacgaccggtgctcgatttagagtatacatattgggtttgtcctcctgctggtggcagctcccagatgggtcctgtccctggtgcaactgcaggagttcggcccacgactggtgacggccttggagaccctgtccctcacctgcgctgtctctggtgcctcatcagtagtggtttntcgngggctgggtccgnacgctccgagggtaggctggatacagttggaagtgtcctctcattagtggtacgttcctaattacgtacgtccgttctctacgaaacgtgttacgacgtcaaccgattaactcctcgtaggaaccctacgttaccaaggacctaaagttccttaacgtttttaccccaggtaaacggatttacgtacgttcgtagtacggtacccgccgtcttacggaaccgtacgggttacttttaacgtacgtgtacggacgtagacggtacgtacgttagttagtacggtttagttttggtacgtttaggttaccgtttaacgtaaccgtaccgttagtaccgtccgggtacgggtcctcccggtacccgtacggggcctaaacggggtcttaaccggtcggttaccnccggttaccgttacccgtttaccgcccgtaacccggtaacccggtaacggtaccccgttaggttacccccggttccgttcccccgtaaccggtccccgtttaaccccgttcccgaacccggttacggtaaccgtccccgg

SEQ ID NO: 142956 - DNA, 569 bp, Homo sapiens
  misc_feature: GYAE6OF02GV4D5.46.67.G01.1.454.CMB.1.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacgtgccgggnaagtcgaacnttcgacacttaattaagtgtatacaanatagaccgagggaccgccctaagcctacctaatctatgctgactactccgtagtttgaacgaaggttcgggtaccagtcggtaggttcaggtggactaggtgatcgtaggactagtacttcgaactctacactatactatactcgtgacgtagtagtaagttattacgaactattattacgtagtactaaatataatactaacgttcgtttaccggacgtaacggtactaacgtaacgttaaactaaattaaacgtacgtagtcgtactacgacactacgtactcgtactctactcctccgtactctcgatacg

SEQ ID NO: 142957 - DNA, 681 bp, Homo sapiens
  misc_feature: GYAE6OF02ISBEZ.46.67.G01.1.454.CMB.1.raw
  modified_base (149)..(149): a, c, t, g, unknown or other
  misc_feature (149)..(149): n is a, c, g, or t
  modified_base (160)..(160): a, c, t, g, unknown or other
  misc_feature (160)..(160): n is a, c, g, or t
  modified_base (200)..(200): a, c, t, g, unknown or other
  misc_feature (200)..(200): n is a, c, g, or t
  modified_base (390)..(390): a, c, t, g, unknown or other
  misc_feature (390)..(390): n is a, c, g, or t
  modified_base (442)..(442): a, c, t, g, unknown or other
  misc_feature (442)..(442): n is a, c, g, or t
tcagactagcagtacacgaccggtgctcgatttagagtatacatattgggtttggggagtctcggtcaggacacagcatggacatgagggtccccgctcagctcctggggctcctgctactctggctcgagtgcagatgtgacatcganctgccagtccncatccgggtctgtctgacacggtgacacgagtctcacctntcgtacgttcggccggactaaggtcgaactattacgaactaccttaagttaagttgtaactcaaatacgtacgaaccgtaacgggccgtaccccaaagtctaactaactctaagtcggctacggacctacttaccgtagtttacggacctaaacgggttccggggtacccctaattccgggtaagtttcngggtaccgtgtagggtagtaacttcgggaaggacgttaagttcccttaaacncgttacctccgtaactataccgaaattactacgacgtactaacgtacgtaacgttagttacgtaacgtaacttacgttacgtacgtactaacgtaattaactacttacgtacggttacgaacgttacggacgtaacgtaactaaacgtaaacgttaaccgtaagttacggagttacaccgtataccgtaacttcggttacgtacttatacccgttcctccgaattcgtactagtacccg

SEQ ID NO: 142958 - DNA, 737 bp, Homo sapiens
  misc_feature: GYAE6OF02I3G9Y.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcgaggagtcgggcccacgactggtgaggccttcggagaccctgtccctcacctgccgctgtctcgtggtcncctcatcgagttagttcggtttcttcggtggggtcgtcgggtccgcacgtccgtccggaaggggacgggtctaggaactagtagtggaagttgtctactcgtagttaggtcggtacgttcctaagttacgtacgttccgtcttcgaagtagtacgtcgactaccacctaattactcgtacgtcgacctaccgtacagaacctactcgttaccgtttaccgaagagttacgtgtacgttctggtaccgccgcgtacgacgacggttcggttactttagtacgtcggtacgacggtacgaacggtcgtaacgtttaacgttaggttagttttaaggtttaggtaacggtttgtttaaccgttaccgttaacccgtacgttaggtaccggaacggggtccggtacccggttaccggacccgggtacggggacgtaacgtaccgttaccggttcgtacccgttaccgtccgtacccgtaccgttccacccggtaaaccgtccggtcctaccggttcccggtccctttccccggatccccctaccgtacctacgtacgccgtacccg

SEQ ID NO: 142959 - DNA, 747 bp, Homo sapiens
  misc_feature: GYAE6OF02IVW7A.46.67.G01.1.454.CMB.1.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctcactcctcctgtctgcgtaaccggtggganacgtagtcgtcaccatcacttcggcccggganaacggtaccggaactcgttacgacctaaccgtttatttaatcggtactacaaccagtaacggtaccgacgggaccgtacccctaagtcctactaactctaagtcgctcgtccacgttccgtaagtttcgaacgtaacggtcggtaccctagtcggtaaggttcgagtcggacgtggtacggtagtcgtaggtactagtaccgttacaccgtacctcgtaactacgtactacgttaacttccgtaacggtacctaaacggttagttaaacgttctttaacggtacctttaaacgtttcttaaaccggtcttaaaccgtaaagttaaccggtaacttttaacggtaaccggtttcggttaaccgggaaacctaacggggtacctaaaccgtaaacttaaaccggttaaacgtaaaccgttatacggggtaccgtaccgtaccgaacgtacccttagttcgttaaccgttaccgtttcctaaccggtttcccgtaccctaggtaaccgtttcaacgggtttac

SEQ ID NO: 142960 - DNA, 630 bp, Homo sapiens
  misc_feature: GYAE6OF02HDWPI.46.67.G01.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgtttctcgtgggctgggtccgnagctcccgagggagggctggaatacagttggaagtgtctctcatgtggaggttctattacagtccgtctctcaagagtcgagtcaccatctctctggacacgtccagacaatctacgttttcccagaagtctgtagttctgtcgaccgccgcgtgacgacgggttnttttacgttactgtcgacgtagaggcgtacttattacgtgttagttttaggaggtttggtttagttcgacctaccgtaagtacgtcgggaccgggtcctccgtacccggtcggggtaccgaaggggtaaccgttcgttacggtccgtaccgttccttaccgtacgtaccctaccgacccggtaaccggtcccacggttcccggttccccttcccccggtacggcccctacccgttcccgtaccgacgtcgtaccccg

SEQ ID NO: 142961 - DNA, 597 bp, Homo sapiens
  misc_feature: GYAE6OF02GNNC4.46.67.G01.1.454.CMB.1.raw
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttgtcctcctgctggtggcagctcccagatgggtcctgtccctggtgcaactgcaggagtcgggccacgactggtgaggccttcggagaccctgtccctcacctgcgctgtctctggtgcctccatcagtagtggttcttcgtgggctgggtccgcagcctccgagggaacgggctggaatacgagttggaagttgtctctcagtagtggaggttcctattacagttccgtctctcaagagtcgagtcacatatctctgacncgtcagcaatctgttttcccagaanatgtagttctgtcgacgcgctgactacgggtctttatcgtgtcgngagacgacggctagttatgttagttttggagtttggttattcgactacctagagtacgacggggtcctaccggacccgtggggaccgaggtaacgtacgttacggtacccgtcgtccttaccgtctacccgtaccgtacggaccctacgtaccgttcccgttcccctccgggtccctaccccgttccctacccgaaccgtacgacctaacccgg

SEQ ID NO: 142962 - DNA, 709 bp, Homo sapiens
  misc_feature: GYAE6OF02JMW2O.46.67.G01.1.454.CMB.1.raw
  modified_base (322)..(322): a, c, t, g, unknown or other
  misc_feature (322)..(322): n is a, c, g, or t
tcagactagcagtacacgaccggtgctcgatttagagtatacatattgggtttgtcctcctgctggtggcagctcccagatgggtcctgcccctggtgcaactgcaggagtcggcccacgactggtgaggccttggacgaccctgtccctcacctgcgctgtctctggtcgcctccatcgtagtagttggtttcttcgtggggcctggggtccgcagcctacccgaggggaagggctggaactcgagtttgggaattcgtctctcatggtggacgttcctagttacacggtcctcttactcaaggcgtacgagttccaactnttaactcctacgtacggacctacggtcccaaggtccaaattccttaacgtttttccaaggactacgttgtacgttcttagtccgacccggtcgtcgtgaccgtagggttccctttttaataccgtggtgccggagtaacggacgtagttatttaacgtgttaacgtttttgggagtttacgtttacgttacgccttaaccgtaagtcgtcgggtacccgggtcgtaacccggtcccggtacggggtaccgaagggttaactccgttacgttcccgaccgttccgttaccgttaccgccttaccgaaccgttaccgggcccttacgtacccggtcccctttaccgacggttacccacccgttaccctaaccgaggttacctaccccgg

SEQ ID NO: 142963 - DNA, 861 bp, Homo sapiens
  misc_feature: GYAE6OF02G9436.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggtccttcggagaccctgtccctcacctgccgctgtctcgtcggtcgccctacatacgagttagttggtttcttcggtggggtcgtcggggtccggcacggtcctcccggaagggggacggggcgtaggaaactactaagttgggtaacggttcgttcctccgtacgtacgttaaggtgggtacggtttacctaaagtttaccgaacgttcccgttactactaccgaaaggtaacggtcggtaacggtacccaaccgtattacgtaccgttccgaacggtaaccgtaccgttaccgaacgtactaacttaccgttaccgttttacccgtaaggtaaggtattacggtactttcgtacggtaccgtacccgtccgtacgtacggaaccggtttacgggttattttacgtaacgttggtacgacggagtacgggaacgtttacgttaagtttaggttacgtttaaggtttaggttacggttttaacgggtttaccgtttaccggtaaccttacccggttagtaccgggttaaccggggtacccggggtcccgtacccgggtaccggtaccgggggaaccggtaacgggttaccgtaacggttccggtacctacccggttaccgtttcccgtaccgtccgacccgtaaccgaacccgggtcccttaaccggtccgtttaccccgtccccgtacggtcccccttaccgtaccccggacctaagtcccgtacccgg

SEQ ID NO: 142964 - DNA, 667 bp, Homo sapiens
  misc_feature: GYAE6OF02GU3G8.46.67.G01.1.454.CMB.1.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctnacctgcgctgtctctggtcgcctccatcagtagtggtttcttcgtggggctgggtccgnagcctccgagggagggctggaactacagttaggagtgtctctcagtaggtggtacgttcctattacgagtccgtctctacaagngtcgagtcacctatctctcgtagacctaccgtccacgtactaaacttcgttaacgttttcccgagtaagtactaggttacgtttcgtacggtacgtacccggccgtacgtacgaccggtaccgggttactttactacggttggtacgtacggacgtacgtacgtacttagttacgtagttttagttttaggtaggttaggtttactttaccgaccgttaccgtagtacggtacgggtaccggggtcctaccgggtccccgtaggggtaccgtaagggtaccttacggttcggtaccgtcccgttccgtttaccgtccgtcccgtaacccgg

SEQ ID NO: 142965 - DNA, 866 bp, Homo sapiens
  misc_feature: GYAE6OF02GZ82G.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctccagatgggtcctgtcctggtgcaactgcaggagtcgggcccacgacgtgggtcgaggccgttcggacgtaccctcgtccctcaccgtggcgtctgtcctcgtggtcgtcctaccatcaggttaggttcggtttcttcggtacggggtcttcgggggtccggacacggtccgtaccggaggggtaacgggtctaggaactacgtagttagggtaacgttgtcctcgtacgtacgttaggtcggtacggtttccttaacgttaccgtacggttcccgtcttaccggtacgtaaacggtacgtacggtaacgttaccgtaaccgttattacgttccgtacgttaccggaaccgtaccgtaccgtaacgtacgtaacgttaccgtttaaccgttttaccaaggtaaacgttacgtacggttaacgttcgggttacgtaccggaccgtccggtacgtcggtaacgtacgggtttacgtttacgttacgtcggttcggacgtaacgggtacgtaccgtacgttagttagttacggtttacgtttcgggttaacgttttacgggtttacctttaccggtacccgtaaacccggttaaggtaccggttacccggggtaccggggtaccggttacccgggttaaccccggggtacggggtaacccggtaaacgggggttaaccttaccgggttaccggtttaccccggtaacccggtttcccggtacccggttttaacccggacccccggttaacccggg

SEQ ID NO: 142966 - DNA, 772 bp, Homo sapiens
  misc_feature: GYAE6OF02JZ2LG.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatccctcctgtctgcaaccggtgganacagtcgtaccaccattctaacgttggacccggggactaaaggtccgggaaacctgtttacggaaacctacctttaaattttaaaagttcggtaactacaaactagtaacgaccacggggtaccgacccctaagcctacctaatcctaattcgactcgacctacttccgtaaggtttcgacgtaaaacgggttccggtaccctagtaccggtacgttccggtaaggtcgggacagggtacgtaggttcgtagggtaactacggttaactttacctaacgttaccgttaccaaccgttaacgtacctaaggttaaacttccgtacgtaccggtaaacggttagtaacgttacgtttacggtacttaacgtttaacttccgttacgtactaaacgtaacgttaaacgttaacttaacggtttacggtttaccggtaacggttaaaccggtacgtaaaccgtaaccgtaaacttaaaaaccgttaacgtaacgttacggtacgttactaccggtaactcgtttaacgttcgttacctttacgtaccttaccgttcccgtactacgtttacttacgtacgttacg

SEQ ID NO: 142967 - DNA, 823 bp, Homo sapiens
  misc_feature: GYAE6OF02JVTJL.46.67.G01.1.454.CMB.1.raw
  modified_base (174)..(174): a, c, t, g, unknown or other
  misc_feature (174)..(174): n is a, c, g, or t
  modified_base (198)..(198): a, c, t, g, unknown or other
  misc_feature (198)..(198): n is a, c, g, or t
  modified_base (272)..(272): a, c, t, g, unknown or other
  misc_feature (272)..(272): n is a, c, g, or t
tcagactagcagtacacgaccggtgctcgatttagagtatacatattgggtttgtcctcctgctggtggcagctcccagatgggtcctgtccctggtgcaactgcaggagtcgggcccacggactggtgaggtccttcggagaccctgtccctcacctgcgctgtctctggtcncctccatcagtagtgtttcttcgngggctgggtccggcagcgtccccgagggggtacgggcttaggaacgtacgtagttcgggtaagtcgtcgtctanagttaggtcgggtaggttaccttacgttaacgcggttccgttccgtcgttacgaaaggtacggttaccggtagttcccgacctaattcgttctaccgttgggaccctacgtcccgtagtaccaagttccttaaccgttttccaacggtaagtcgttacggttacgttcttcggtaccgggtaccccgtaccggtcgttaacgaccgggtaccggttacctttacgttaaccgttcggtacgtacgggaacgtacggaaccggtttgttaacgtttagtaccggtttaaggttttagggttaacggtttcggttttaagtttcccggaaacccttacccgttaagggccgtttacgggggtaccgggttcccgtacccgggttacccgggtaccggggaacgtaacgggtacgttaaccgggttcgtaacccgtacgttccgtacgttacccgactcccggtaacccggtaaccggtccgtacggttccccgttcccgttaccccggtcgtaccccggtcccgtaaccgtaccggaacgtccgtaaccccgg

SEQ ID NO: 142968 - DNA, 828 bp, Homo sapiens
  misc_feature: GYAE6OF02FM34B.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctccatcagtagtgtttcttcgtggggctgggtccgcagcctccgagggagggctaggaatacagttggagtgtctctcatagtggaggttccttattacgacgtccgtctcgtacgaagtgtcgtagtacacccgattacttcttccgtaggtacctaccgtacccgtaacgaccgtaactttcgttaaccggtttttcccctaaggaaacgtagttggtacgtttacgttaggtaccgaacccggtcccgtcgtaaacggtccggtaacggggttcctttttaacggttataccggttgacgggtaggaacggtaacggtcgttaatttacgttaggtttaaggttttttagggtaagggtttacggttttacgttttaaccggtaacctaacccggtttagtaaccgggttaccggggtacccggggtaccgtaccccgggtaccccggtcggggaaccccgggtaacggggtaaaccgttccggtttaacgggtacccgttaacccggttccctttccggttacccgtacccgttacccggtaacccgggttaacccggaccccgttaccggttaccccggtttaccctttccccccgggtacggttacccctaccccctttccccgaaaccggtaccgaccggttaccccgg

SEQ ID NO: 142969 - DNA, 647 bp, Homo sapiens
  misc_feature: GYAE6OF02FIIZX.46.67.G01.1.454.CMB.1.raw
  modified_base (226)..(226): a, c, t, g, unknown or other
  misc_feature (226)..(226): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
tcagactagcagtacacgaccggtgctcgatttagagtatacatattgggtttgggagtctcggtcaggacacagcatggacatgaggtccccgctcagctcctggggctcctgctactctggctccgaggtgccagatgtgacatcgagctgacccagtctccgatccctccctgtctggccaaccggttgggagactagtgtcaaccatccgacttgccggganagtcggaactatgactaccttagtttaaatcggatacaacagtagaccaggggaccgcccagcttccgtaatctatcgactgctactcctagtttggactaaaggtgggtacccagtcggaagttcaaggttggctaggtgactcgtagggaacagtacgttcaaccgttcctaccgacctacgtaccgagtaacttccgngtaccgaacgtaggtaaactctttanccgtaaactttaccgttataggtacctaaccgtaagtaactttaccgtaagtttccggttttccggacttacggggactaccggttaaacaaccgttaaaataaacccggtatagggttacgacgtaggtcccaaaggtacccttaggttctacccttactacttccggtacccgtcctactcgttacgtaccg

SEQ ID NO: 142970 - DNA, 685 bp, Homo sapiens
  misc_feature: GYAE6OF02HZR42.46.67.G01.1.454.CMB.1.raw
  modified_base (278)..(278): a, c, t, g, unknown or other
  misc_feature (278)..(278): n is a, c, g, or t
  modified_base (353)..(353): a, c, t, g, unknown or other
  misc_feature (353)..(353): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctccgagggagggctaggaatactagttaggaagtgtctctcagtagtggtacgttctattacncgtccgtctctacaagacgtcgagtcactatactctcgtacgacacgtccagactatctacgtttccagaacgtntcgtagttctgcgaccgcgcgtacgacgtacggtactttacgtacgtgtcgacgtagacgtacgtattagttattgttagttttaggtaggtttcggtttactttaccgaaccgtaccttaggaccggttcggggacggggtccctacccgggtacccgggtacgggggtaccgtaaagggtacgttaaccgttcggtacccgtaacccgttccgttaacccgtaccgtccccttaccgaaccggtaaccggtcccgttacggttccccggtttaccccgttccccggtcggttaccccaccccggttaccctaaccgacgtaccgtacccg

SEQ ID NO: 142971 - DNA, 676 bp, Homo sapiens
  misc_feature: GYAE6OF02IPQL0.46.67.G01.1.454.CMB.1.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (627)..(627): a, c, t, g, unknown or other
  misc_feature (627)..(627): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccctagtctccactcctcctgtctgcaaccgtggagacngtgtcacatcacttgccggnacggtcgaacattcgactacctagttaagttgtatcaactntacgaccgaaggggaccgtccccgtaagcctacctaattctaagtgctggctatccgtagttcgacgtaaacggtcgggtacctagtacggtacggttctagggtcgacgtaggtgagttccggtgggaactagtactttacaccgttctaacctacgtaacttcgtaacggttaacttcgacgtaacgtaaacggttacgaacgtttattttcggaaacctttaacgttactttaagtaccgttaacaaaggtactaaacttaaccgtaacgtttagttaccccggacgtaacggggacccttaaacggtaactaacgttaaaaaccgttaaacgaacgttaaggaccgttacaccgtaccaacgttacncgtttcgacctttactccgttaccttcccgacgtaacttccgagttacc

SEQ ID NO: 142972 - DNA, 757 bp, Homo sapiens
  misc_feature: GYAE6OF02HV6PK.46.67.G01.1.454.CMB.1.raw
  modified_base (97)..(97): a, c, t, g, unknown or other
  misc_feature (97)..(97): n is a, c, g, or t
  modified_base (555)..(555): a, c, t, g, unknown or other
  misc_feature (555)..(555): n is a, c, g, or t
  modified_base (647)..(647): a, c, t, g, unknown or other
  misc_feature (647)..(647): n is a, c, g, or t
  modified_base (696)..(696): a, c, t, g, unknown or other
  misc_feature (696)..(696): n is a, c, g, or t
  modified_base (717)..(717): a, c, t, g, unknown or other
  misc_feature (717)..(717): n is a, c, g, or t
tcagactagcagtacacgaccggtgctcgatttagagtatacatattgggtttggggagtctcggtcaggacacagcatggacatgagggtccccgntcagctcctggggctcctgctactctggctcgaggtgccaggatgtgacatcgagctgacccagtctccagtccctccgtgtctcgaccgaaacggtgggacgactaggtacgttaccaaccgtacttccgacgtttacgggaccccgggtataaacggtaccgggtaaactacgtttacgaaacctaaccgttttaaatttttaaaacgttggtacttaaccgaacgtaaataacggacccggtaacggggacccggtaccccttaaaggtcctaaccgttaaactttcctagtacggtcctacgactacgtaccgtaaggttttaacgaccgtaaacggggttcgggtaccctagttaccgggtaggttacgagggtacgaggacgttagggcgttacggtgggactacggtacgttacactttccgaaccacttagaacttaacgtactacggtnacgtaacgtagttaatagtttacgacttacttaatacttacgactaacgtactaagtactacgttagttacgaacgtaacgtacaacgtaanaacgttaaaacgtaaccgaagttggacgtactacgtaaccgtaaacgtnttaccgtacggtttacccttnacccgtttaccggtacctaccgtacgttgaaccttaacgg

SEQ ID NO: 142973 - DNA, 1006 bp, Homo sapiens
  misc_feature: GYAE6OF02JB6VN.46.67.G01.1.454.CMB.1.raw
  modified_base (215)..(215): a, c, t, g, unknown or other
  misc_feature (215)..(215): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgccgcttgtctctggtcgcctcatcagttagtggtttccttcggagggtctcgggtccgnacgcctcccgaggggaggctaggaatacagttggaagttcgtctactatagtacggtaggtaacggtttcctaagtttaccgaacgttcccggtaccttaccgtactaacggtacgttacggtaacggttaccaacccgtattaaccgttccgtacgttacggaacccgttaccgtaccctaaggtaacctaacttaccggtttaactttttacccccggagtaaaacggttctacggttaagtttccgtttacggtaccggtaacccgtcccgaacgtacgggtaaaccgtccggggttttaacctttttaacgttacgttcggtacgtaccggtaaggtaccggtaccggttacgtttaacgttacggtttaggtttaaacgtttttagggtacggttttaagggttttaccgtttaaccggtaacccttaaacccgggttacggtttaaacccggggtacccgggtacccgggggttacccgggttaaaccccggggtaaccccgggttaccggggggtaaacccggttaacggggtaaaacccgggttttacccgttaacccgggggttttacccgtaacccccgggtttacccgtttaaccccgggttaaccgtacccccccggttaacccgtaaaccccccgggttaaaccggggtaaccccctttaacccccggggttcccggttttaccccccgttacccccggttaaccccgggttccccctaaaccccccggtttaacccccggtaaccggtaaacccccggttacccggtaaccccccgg

SEQ ID NO: 142974 - DNA, 694 bp, Homo sapiens
  misc_feature: GYAE6OF02GM6EZ.46.67.G01.1.454.CMB.1.raw
  modified_base (198)..(198): a, c, t, g, unknown or other
  misc_feature (198)..(198): n is a, c, g, or t
  modified_base (453)..(453): a, c, t, g, unknown or other
  misc_feature (453)..(453): n is a, c, g, or t
  modified_base (544)..(544): a, c, t, g, unknown or other
  misc_feature (544)..(544): n is a, c, g, or t
tcagactagcagtacacgaccggtgctcgatttagagtatacatattgggtttggggacgtctcggtcaggacacagcatggacatgaggtccccgctcagctcctggggctcctagcctactctggactccgaaggtgccagatgtgacatcgaagctcgacccgagttctaccgatcctccgtgactgcaaccggnggtagacgagtgtcaccagtacctagttcggaccgggtcgaaacgttcggaactacgttaggacctaaccttatttaaaggttggtacttacaacgacgtaaaggtaccacggaaaccggtcccgtaaacgtcctccttaaatccgttagtactacgttaccgactacttccgttagttacgtaccgggaaagggttcgtaccgggtacctagggtccgttaagtcggagtcgtaacggtcggatttccggacgntacgggtctaacgtcgaaccttcggaacctcgtaagtaccgtacgtatacgtacacgtaagtcgtaatacgttcgacttacgtacttaacngtaacctagttaactactaacgttacgttaccgtaaggttcccggaagtaaccgtaacggaacctaacttaaacgacgttaaccgtatcgacggttcgaacgttccctagtaccgtactcgttctactccttaacggtctcgttacgacc

SEQ ID NO: 142975 - DNA, 553 bp, Homo sapiens
  misc_feature: GYAE6OF02F9MHE.46.67.G01.1.454.CMB.1.raw
  modified_base (192)..(192): a, c, t, g, unknown or other
  misc_feature (192)..(192): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattgtatcaacatagaccaggacggcccctaagctcctaatctatgctgcatcctagtttgcaaagtgggtcccatcgaggttcagtggcagtggatcgtgggacaggactttcactcgtcaccatcagtaatctagcaacgtgaagtattttaggactaaacgttacttacttagtactaaacacgtaaatttaacaattcgttttacggaccgtaagggtaccacgtaactaacaaaacttaaacgaactgtacggntaggaccacgtactctacgttacttcacgttccttacccgctatctataac

SEQ ID NO: 142976 - DNA, 693 bp, Homo sapiens
  misc_feature: GYAE6OF02F8713.46.67.G01.1.454.CMB.1.raw
  modified_base (359)..(359): a, c, t, g, unknown or other
  misc_feature (359)..(359): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggacgaccctgtccctcacctgcgctgtctctggtcgcctcaatcgagtagttggtttcttcgtgggctgggtccgcagcctccgaggggaagggctaggaatacagttaggaagtgtctctacagtaggtggtaggttcctaattacgagttccgtctctacgaagtagtcgagtcaccatatctctggacacgtccagcaatctacgttttcccagaagntagtagttcgtgtacgacccgtcgcgtacgacggacgggttgtttacttacgtcgttagacggaaggacggtacggtactttaagtttagttcgtttaaggtttttagggtaggtttagggttttactttacgtaaccctaccgttagtacgtcgggtaccggggtcctacccgggacccggtcggggaccgtaagggtacgtacgttcgggtacctaccggttcctaccgttaccgtccctaccgaccggtaaccggtaccctacggttcccgttccccgtttacccccggcgttacccaccccgttcccgtacccggtaacgccgtaccccg

SEQ ID NO: 142977 - DNA, 855 bp, Homo sapiens
  misc_feature: GYAE6OF02H69UI.46.67.G01.1.454.CMB.1.raw
tcagactagcagtacacgaccggtgctcgatttagagtatacatattgggtttggggagtctcggtcaggacacagcatggacatgagggtcccgctcagctcctggggctcctgctactctggctcgaggtgccagatgtgacatcgagctgacccagtcctccactcctccctgtctcgcgaacgtgggagacgagtcgtacaccatcacgttcggccggggacaacggtcggaaaccagtttacgaacctaactttaacgttttaaaaagttcgggttaactaaccgtaaacgtaaagttaacggaaccccggtaaggggggacccccggtaacccccgttaaaggacccctttaacccgtttaaaattccgttaaagtttacggcgttacgaccgtaacgtttccctaacgggttttacggaaccgtaaaagggggtttcccgggtaccgtaaacgtttccgggtaagggtttccggtaagggtcgggaacgtaggggttacggtacggttcggtaccggggtaaattacggtaacgttttccgaacttacccgtaccgtaacctaatttaccggtaagttaacttacgtacgtaaacggtaacgttaaggtaaacgtttagtttaacggaacctttattaaacgttacttaacggttaaacgtaacgttaaagtttaacttaacggtaacgttttaccggttttaaccgggtaaccgaacggtaactaacccggtaaactttaaacgtaaacgttaaacgtaagttcggtacggactacggtcctaacgtcttcgtaaccgtttactaccgtttctacccgttccgtaccctttagtaccgttaggtacc

SEQ ID NO: 142978 - DNA, 847 bp, Homo sapiens
  misc_feature: GYAE6OF02F9PBJ.46.67.G01.1.454.CMB.1.raw
  modified_base (145)..(145): a, c, t, g, unknown or other
  misc_feature (145)..(145): n is a, c, g, or t
  modified_base (834)..(834): a, c, t, g, unknown or other
  misc_feature (834)..(834): n is a, c, g, or t
tcagactagcagtacacgaccggtgctcgatttagagtatacatattgggtttggggacgtctcgggtcaggacacagcatggacatgagggtccccgctcagctcctggggctcctgctactctggctccgaggtgccagatgngacatcgagctgacccagtcctccatcctccctgtctgcaaccggtgggagacagtcgtcacctagtcctacgttcggcccggggactaacgtaccgggaaacctagtttacgaacctaacccgttaagttttaaaacgttaggttaacttaccaaactaataaccggaacccggtaacggggtaacccggtacccccgtaacggtaccttacccttaaacgttaccgttaacgttagtaccggttacgtacctaccgttcccgttaaggttttacgaaccggtaaaaccgggttcggggtaccctagtaccggtacggttacgtacggtcggacgtaggtaggtacgttcggtacgggtaacgtgttacttaccgtaccgttaccgtacctaaccgtactactaacggttaactacgtacgtactaaacggttaggaaacttagttttaacaccgttaactttaacttaccgtaataacctaacgagttaaacgttcgtaacttaacgtttcggtttaccgggaccgtaaagggtaacccttaacggtaaacctaaaagttaaaaccgttaaccggtaaaggttaccgtagttaacccgtcgtaaaccgggttaaccttacggttaccttaacggtttacgtttaacccgttaacgttaccccccgtttacccggaccttttaaccgngtttaaacccggg

SEQ ID NO: 142979 - DNA, 576 bp, Homo sapiens
  misc_feature: GYAE6OF02JZ646.46.67.G01.1.454.CMB.1.raw
  modified_base (150)..(150): a, c, t, g, unknown or other
  misc_feature (150)..(150): n is a, c, g, or t
  modified_base (158)..(158): a, c, t, g, unknown or other
  misc_feature (158)..(158): n is a, c, g, or t
  modified_base (269)..(269): a, c, t, g, unknown or other
  misc_feature (269)..(269): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (559)..(559): a, c, t, g, unknown or other
  misc_feature (559)..(559): n is a, c, g, or t
tcagactagcagtacacgaccggtgctcgatttagagtatacatattgggtttggggagtctcggtcaggacacagcatggacatgaggtccccgctcagctcctggggctcctgctactctggctccgagtgccagatgtgacatcganctgacccngtctccagtcctccctagtcctgcaaccggtggacgacagtgtccaccatcacttcggccgggacaagtccggaatagttagacctactaagtttaaatggtatacaacgntacgaccgagggacgacccctaagcctacctaatctatcgctgcactcgagtttgaacaagtcgggtaccntagnggttcagtcggctagttggattcgnggacgtgtaacttcactcctnaccagttccaagttactcganacgtaagntacgtactttgaactacgttatntaagtcaacgtagaaattcaagttcttaccggattaacgggnaccggttaacaagtaactaaagcgttananccgtntacccaagtccttaaggtcttacgtactactccgttaccncggactttcggattacg

SEQ ID NO: 142980 - DNA, 883 bp, Homo sapiens
  misc_feature: GYAE6OF02F0ZZM.46.67.G01.1.454.CMB.1.raw
  modified_base (814)..(814): a, c, t, g, unknown or other
  misc_feature (814)..(814): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagccgtacgacccagtcctaccacttccctcctgtctacggaccgtaaccggtagggacacgtagttcgtaccaccgtactccgtacgttacggccgggtaactaacggtacggaaactacgttacgtaaccgtaaccgtttaaagttttaagttacggtaactaaccgaaagtaacgttaaccgggaacccgacggggtaaccccggtacccccttaaacggacccttaacccgtaaacttactacgtacggtactaccggtaccgttaaccgttacccgttaggtttaaccggtaaccgggttaacggggttaccccgggttaaccgttaccggtacgggttaccggttaacggtacgggtacggtacggtaacgggtcgggtaaccggttaccggtttaacgggacgtttaaacggtttacttaaccgtccgttacccaaccgtacgttaacgtaaccgtaaacgtttaacgtccgttaacgaaccggttaaggtaacggttaacgttacgtttaaccggttaaacttaaccgttaacgttacggtaaaccgtaacctaaacgtaacttaacgttaagttaacggttaccggtacggaaccggtacgtaaccgaacggttaactaaacgggttaaactaacggtacgtacggttacgganacctaccgtactaactttacgtacctacgttcccgtaccttacccgtaccgtactaccttacgtattcg

SEQ ID NO: 142981 - DNA, 842 bp, Homo sapiens
  misc_feature: GYAE6OF02H3JIQ.46.67.G01.1.454.CMB.1.raw
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
tcagactagcagtacacgaccggtgctcgatttagagtatacatattgggtttgggggacctcctgcgcaagaacatgaagcacctgtggtttgtcctcctgctggtggcagcctcccagatgggtcctgtcctggtgcaactgcaggacgtccgggcccacgacgtggtagacggtccttcggacgtacccgtgtcccctcacctggcgctgtctcgtggtcncctcagtcagtgttgtttctcggtgggcgtggccgnacgcctaccggaggggacggctaggaactcgtagtaggtagtgtcctctacgtagtacggtggtacgttccttaagtcgtcgttccgttactccgtacgaacggtcgtacgtacgtaccactaatacgtctcgtacgactaccgtacagactaacgttcgttaaccgttttccaagtacgtacgttagtttacggttccgtacggtccggtacccccggacgttccgtaaccgggtacgggttaaccggtttaccgttttaacgttcgggtcgttacggaccgggtaacggtaccgggttaacgttacctttaaacggtttaggttttaccggttttttaagggtttacgggttaagggttttttacgtttaaacccccgtttacgggtaaaccccgtttaacccggaggggttaacccgggtttaccccggggggaccggtttcccccggtaaccccgggggttcccgggtaacccgggggaacggttaaacgggttacccgtttaccgggttaccgggtaccccgtttacccgggtttaaccccgtttaccggttaccccggttaccccctaacccgggg

SEQ ID NO: 142982 - DNA, 671 bp, Homo sapiens
  misc_feature: GYAE6OF02H1LGP.46.67.G01.1.454.CMB.1.raw
  modified_base (217)..(217): a, c, t, g, unknown or other
  misc_feature (217)..(217): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccggganagtcggaacatgaccactaatttaattgtatacaanatagaccgagggaccgcccctaagccttacctaattctaatcgtactggcagtcctagttttgacgtaaaggtcgggtacccagttcgacggtttcaggtggacaggtgtagtacgtgggaacgagtagttacctactccgtactacctatacgtaggttaactcgtagacgtaaacgttagtaagttatttacgactttaactttagttaaccttacgtacaacgtaacgttaaattaacgtaagtttcggtttaaccggaccgtaacgggtaaccgtaacgtaaccgtaaacgttaaaacttaaaacggaacgtttaacggtacgtacgtaacgtaccgtaacttacgttcttacggtttaccttaccgttacgttcccctttacccgacccttaacgttacgttacgttaacccg

SEQ ID NO: 142983 - DNA, 756 bp, Homo sapiens
  misc_feature: GYAE6OF02GXYH3.46.67.G01.1.454.CMB.1.raw
  modified_base (124)..(124): a, c, t, g, unknown or other
  misc_feature (124)..(124): n is a, c, g, or t
  modified_base (200)..(200): a, c, t, g, unknown or other
  misc_feature (200)..(200): n is a, c, g, or t
  modified_base (749)..(749): a, c, t, g, unknown or other
  misc_feature (749)..(749): n is a, c, g, or t
tcagactagcagtacacgaccggtgctcgatttagagtatacatattgggtttggggtagtcgtcggtcaggacacagcatggacatgagggtccccgctcgagctccgtggggctctgctacnctggctccgagtgcctagatgtgacagtcgagtctgacccagtcctcgactcctccctgtctgactaaccgtgggnacagtcgtacaccatccacttggccgggtacaagtcggacagttagaccacttaattttaaagtggttatacgtaacgatacggacgaaggtaccggacctaagccctactaactacgtaagtcgtactcggctaacttcctaacgtttagaacgtaaacggggttcggttaacccgacgttcggtaacggtttcgaaggttccggaacgttaggtaccggtaagttccgtagggggaaactcgggtaacgttttccgaaaccttttcccgtaccgaaccttacgttaactaacgttaaacggttctttcgaaccgtaaacggtcgtaaacggttacgtttacgtaacgttaacttaaggttaccttaggtaaacccttaacgtaaagtaaacttaggttaaccgttaggtttaaccggaccgaaacgggttactaaacccggtaataaaccgttaaaacctaaaacgggtccttaaagggtcgttacacgaccggtaactcgggtataccggtttactccacgttaccctccggacctacggttaccnttaaccg

SEQ ID NO: 142984 - DNA, 945 bp, Homo sapiens
  misc_feature: GYAE6OF02HA0AM.46.67.G01.1.454.CMB.1.raw
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
tcagactagcagtacacgaccggtgctcgatttagagtatacatattgggtttgtcctcctgctggtggcagctcccagatgggtcctgtccctggtgcaactgcaggatcgggccacgactggtgaggccttggagaccctggtccctcacctgcgactgtctctggtgcctccatcagtagtggttctcgngggctgggtccgnacgcctccgagggacgggctggaatacgagttggaatgtctctacagtgtggaggttcctagttacagtaccgtctctcaagtacgtcgagtcgaccatactctctcgggactccgtacacgtcgtaactaccgagtttttaccccaggtaaacggtattaggtacgtttaccgttggttaccggtaacccgggtccccggtacgttaacgggtaacccgaccgggggttaccggtttttaaacgtttaccgttagggttaccgggttaacggaacgggtaaccgggtaccgggttaaccttttaaacggttttaacgttacgggtttaagggtttttttaccggggtaaaggggtttttacgggtttttaaaccgtttttaacccggtaaacccggttaaaccccggtttaaacgggtaaccggtttaaaccccggggggggtccgggggtttaacccgtttaaccccggggtacccccggggttaccggggggtaacccggtaaacggggggtttaaaaccgtttacccgggttaaccggggtttaccccgttaaaccccggttccggtttaccccgtttaacgggtccccctttaaccggaaaccccggggtaaacccggggtaccccctttaacgggttacccccggttttacccccgtttaccccccgggttaccggtaaccccttaccccccggtttacccggtaaccccgttacggacccgttaacccccgg

SEQ ID NO: 142985 - DNA, 602 bp, Homo sapiens
  misc_feature: GYAE6OF02F0J7A.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacctatttaaatgtatcaacatagaccagggacggcccctaagctcctaatctatgctgcatccagtttgcaaagtgggtcccatcgagttcagtggcagtgatcgtgggacagatttcactctcacatcataatctgactaacgtgaagtattttcgactaacttattaacgttacgttacaaactaagtaaatttaactaatttcggtttttaccggaaccgtaaagggtaacctaacggtaaccttaaacgtaaaaacgtttaaaaccgtaaacttcggttacggtacttacggacctaaccgtaacttcgttacgttacctttactacttcccgtttccccgaccttaacttcctagttaaccc

SEQ ID NO: 142986 - DNA, 647 bp, Homo sapiens
  misc_feature: GYAE6OF02FLZ9M.46.67.G01.1.454.CMB.1.raw
  modified_base (295)..(295): a, c, t, g, unknown or other
  misc_feature (295)..(295): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtccctcacctgcgctgtctctggtcgcctccatcagtagttggtttctcgtggggctgggtccggcagcctccgagggagggctggaatacagttggaagtgtctctnataggtaggtaggttcctattacgagttcccgtctctacaaggtacgtcgtatccaacctatactcgtctggaaccaccggtccagactaacgttcttaccgtttttcccaggaaaggttactaggtacgtttcgttaggtccggaccccgtccgctacgggaccggtaacggggttcttttaactacgtgttacgcgaagtaccggacgtcttagttgtgtttagttttgggtagttggtttaactttccgaacctcgtaagccgtacggggacccgggtctcccggaacccgtggggccgaaggttaatccggtggtccctaccggctttacccgtaggtccctacccgg

SEQ ID NO: 142987 - DNA, 1025 bp, Homo sapiens
  misc_feature: GYAE6OF02I42KE.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcactgcgctgtctctggtgcctcatcagtagtggtttcttcgtgggctgggtccgcagcctccgagggagggctaggaatacgtagttaggaagttcgtacctcgtacagttaggtggtacggtttacctaagttacgacggttccgtcttacgtacgtaaggtaggtaccggaagttccaacccgtagttacttccttaccgttacggaacctaccggttacccaacggtacctaaacgttccgtttaacgtttttaccccgaggaaacgttagttacggttacggtttaccgttgggtacccgtaacccggtccccggtcgttacggtaaccggtaaccggggtttacgtttttaactttaccggttgggtacggtacgggtaacgggtaaccggttaacggttaccgtttaaaggttttaacgttttacggttttaacggttttttaacgggggaaggtttttacgggtttttaaaccgtttaccgggtaaaccccgtaaaccccggttttaaaggtaacccgggtttacccggggggtaacccggggggttccccttaaccccccgggggtttacccccgggtaaccggggggtaaccccgggtaaaacgggggtttaacccggttaaccgggtttcccggggttaaccccggttaaaccccggttttcccggttaaccccggtttaccggttaccccccggtacccggttaaaccccgggttaacccgggtaccccccggtttaacggtttcccccggggttttaacccccccttttccccccgggttaccgggttaccccccgttaaacccccccgttttcccccgggtaaaacccggtaacccgggttccccgtttaaacccccggg

SEQ ID NO: 142988 - DNA, 660 bp, Homo sapiens
  misc_feature: GYAE6OF02H9HVP.46.67.G01.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcgaaccggtgggacacagtgtcaccatcacttggccgggnaagtcggaacnttgacacttatttaatggtatacaanatagaccgagggaccgaccctaagctacctaatctatcgctagctatacctagtttacgacgtaaacgggtcgggtacccagttacggtaggttcgaggtcggacgtaggttcggagttcggtagggtactagtactttccacgtactacctactataccgtaagttactcgttacgacgtaacgtagtaaacgttagtttacgtaaccttaacgttttacttaccgttagtaaccaaacgtaagttaacttaacgttaacgtttcggtttaaccggaaccggtaaggtaacctaacggtaaccttaaacgtaaagttaaaccggtaagttcgtacggactacggacctacgtacttccgttacttccttacgtccttaccgttcctactacttacacttacg

SEQ ID NO: 142989 - DNA, 676 bp, Homo sapiens
  misc_feature: GYAE6OF02IXRCR.46.67.G01.1.454.CMB.1.raw
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
tcagactagcagtacacgaccggtgctcgatttagagtatacatattggggtttggggagtctcggtcaggacacagcatggacatgagggtccccgctcagctcctgggggctccctgctactctggctccgaggtgccagatgtgacatcgagctgaccctagtcctccatccctcctgtctncacgtgggancagtgtccacactcacgttcgaccgggacaacgtcgggaacctattcgaactaaccttatttaaacgtgtactcgaaactataacgacccggagggacccggaccccaagtacctacctaatctaagtcgccttgactactacccgtagttacgacgttaacgggttccggtccagttgtacggtccgaggtcggtctaggtgaaccttgtcggaactagtactttacacgttccaccgtaccgaatcgttaagtactacgtactacgtaacgtagtaagttagtttacgtaacttaacgttatttaacttacgttaaccgtaaacgttactaaagttactaacggtttcgttacgtaacgtacggaacgtaccgaacttaactaaaacgttaacgtagtagtacgtacgtactaccggtacacgttactacttacgttacttaccgttaccgttaccgtaacgtacctacgttagtaacc

SEQ ID NO: 142990 - DNA, 707 bp, Homo sapiens
  misc_feature: GYAE6OF02HRSBX.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtcctccatccctccctgtctgaccaaccggtggganacagtgtcacatcacttgccgggcaagtcggaactattcgactacttaatttaaagtgtatacaacatagaccgagggaccggaccctaagctactaatctatgctgacactcctaagtttacgacgtaaagggttcgggtaccctagtacggtaggtttcaacggtggactaggtacggtacgtcggtacggggaactaacggtactttacaccttacgtaccaacctaagtactaaaggtaacttacgtacgaaccgtaaacggtaaggtaaagtttactttaacggaacttaaactttaacttaacgtagtaaccgaaaactaaagttaaacgtaaactttaacgggtttacggttttaacccgggaaacctaaagggtaaccctaaacggtaaacttaaaccgtaaaacgttaaaacgaacgttgtacggactcgaaccgtaacttacttacgttacgttacttacgtacctttccttaaccccgtctaacttctaacggttaac

SEQ ID NO: 142991 - DNA, 737 bp, Homo sapiens
  misc_feature: GYAE6OF02GM6Q4.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgacaactgcgaggacggtccggccgacgacgtgggtggacggtccgttcggacgaccctcgtccctcacctcgcgtctcgtctcgtcggtcgcctcatctagtacgttggtttcgtcggtggggtcgtcgggtccgcgacgccgtaccggaaggggacgggtcgtaggaactactaggtaggaacgttcgtctcgtctagtaggtggtacgttactacgttacgtaccgttccgtactacgtacgaagtacggtacgtaacgtaccaacgttactacttccgtacgtacgtaccaccgttacgacgacttaacttcgtttaccgtttaccaggtaactcgtacggttcgtcgttcgtaccggacccgtcggtacgtacggtacgttacgggttacctttaagtcgtcggtacgacggtacgaggttaccgtatttacgtagtttcggttaaggtttggtacgtttacggtttacttaccgaaccgttacgtacgggtacgacccggggtacggtccgtacccggtcgggacgggtaaccgtagggttaaccgtcggtaccggttccctacccggttacctccgtaccgtacccctacgg

SEQ ID NO: 142992 - DNA, 566 bp, Homo sapiens
  misc_feature: GYAE6OF02G9V2P.46.67.G01.1.454.CMB.1.raw
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
  modified_base (409)..(409): a, c, t, g, unknown or other
  misc_feature (409)..(409): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtgggctgggtccggcagctcccaggggaagggctggaatacattggaagtgtctctcagtagtggaggttcctattaccagtccgtctctcagagtcgatcaccatntctctggacacgtccagcaatcacgtttcccngaantgagttcngtcgaccgcgctgacncgggtctttatcgtgtagngagagacggctagttagtgtattttaggngttaggttatttcgactaccctaagcgtacggtacgggctccgacccgtggggccgagggatacgtggtcctacgtcttccgtacgcctaccgaccgacggccctagtccggtccttccccgtggcctaccccgttccctaccgtacgtcgtacccg

SEQ ID NO: 142993 - DNA, 715 bp, Homo sapiens
  misc_feature: GYAE6OF02I2V5A.46.67.G01.1.454.CMB.1.raw
  modified_base (193)..(193): a, c, t, g, unknown or other
  misc_feature (193)..(193): n is a, c, g, or t
  modified_base (651)..(651): a, c, t, g, unknown or other
  misc_feature (651)..(651): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctcatcctccctgtactgccaaccgtggganacagtgtcaccattcacttgccgggacaaggtcggaacattcgactaccgttaatttaaattcggtaatacaaacattaacgaccgtagggacccgacccctaagcctacctaatcctatgcctagcactccgtagtttgacgtaaacggtcgggtacccctaagtccggtaggttcaggtcggactagtggactcgtagggactaggtactttcgacgttctaccgaacctacgtcgtaataactcgtacgacgtaacggtacgaaagttacgttttacgaccgttaaactttacttaccggttaagttaccaaaccgtaaaggttaaactttaaccgtaagttttaccggtttaccgggaaacccgtaaacggggtaacctaaaccgggtaaacctaaaccgttaaaaaccgttaaacggtaaccgttagtaccgggtacctaagtaacccgtaanaccgttacttcgttaaccgttacctacgtttccgtaccccgtcctaaggttccctagttaaccc

SEQ ID NO: 142994 - DNA, 643 bp, Homo sapiens
  misc_feature: GYAE6OF02FQB60.46.67.G01.1.454.CMB.1.raw
  modified_base (176)..(176): a, c, t, g, unknown or other
  misc_feature (176)..(176): n is a, c, g, or t
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (467)..(467): a, c, t, g, unknown or other
  misc_feature (467)..(467): n is a, c, g, or t
  modified_base (533)..(533): a, c, t, g, unknown or other
  misc_feature (533)..(533): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcgggagaccctggtccctcaccgtgcgtctgtcctctggtcncctccatcagtattggtttctcgtggggctgggtccgnagctccgaggggaagggtctaggaatacgagttgggaagttcgtctcnctagtaggtggtaggttcctaagttacacgtccgtctctacaagagtcgtagtccaccatactcgtacgtcggaccgacgtccagtacctaacgtctacgtttttccccgagaagtagtacgttagttctgtaccgaccgtccgtcgtaggaaccgtacgggttacgtttattacgtgtagcgtaggtacgcggtacttaagttntaggttagtttggaggtttgttattcgacctaaccgttagtacgtcgacgggtctaccgacccggngggtaccagggtactcgtgtccgaccgtcttaccacgtccacccagtaccggtcctacgtccggttcccttcccgtcggacctccccgtaccgtaccacgtacgtacccg

SEQ ID NO: 142995 - DNA, 818 bp, Homo sapiens
  misc_feature: GYAE6OF02G786J.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtggagacngtgtacaccatctacttcggcccgggacaaggtacggaactagttacgaacctaaccctttaagtttttaaaagttggttaactaccgaaactaacgttaacggaaacccggtaacgggggacccggtaccccccgttaaaggtacccttaacccttaaaacttaccgttaagttcggcttcggtactaactccgtagtttacggacgtaaacgggttcggggtacccctaggttacggacggtttacgacggttggacgtaggtacgggtacttcggtacgggtaacacggttactttaccgacttcctaccgaacttacgtaactaacggttaactccggttagaaccgtaacggtagtaacgtttatttacggtaaccttaaacgttttcttaacgtaggttaaccaaacgtaaagttaactttaaccgtaagtttccgggtttaaccggtaaccgtaaacgggtaaaccgtacctaaaaccgtttaaaccgtaaaaacggtttaaaccgaaggtttacggtaaccggtacctacggtaaccctacgtttaaacgtcggttaccttaccgttttaccactttccccggttacccggtaccttacggttacctggttaacc

SEQ ID NO: 142996 - DNA, 865 bp, Homo sapiens
  misc_feature: GYAE6OF02G14MA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacgaaccggtgggacgacagtgtacaccatcacttcggccgggacaaggtccggaactagttacgaacctaaccttaattttaaaagttttttcggaattaccgaaaactaacgttaacggaacccggtaagggggaacccggtaccccctaaaggtccttacccgtaatacctatcggcctggtccacgttcccgtaggtttacggaccgtaaaaggggttccggggttaccctaacggttacgggtaacggggtttaccgtaagggtcgggaacgtacgggtacgggtacttcggtaggggtaacctaggtttaacttttacccgaaccgtttacctaccgaacctagttaccgtaagttaacttccgtaggaaccgttaacggtacgttaagttacgttttacgaacctttaaacgttttacttaacgttacgttaaccgtaaacgtaacgttaaactttaaccgttaagttttaccgggttttaaccgggaacccgttaaaggggtaaccctaaaccgggtaaaccttaaaacgtaaaacggtttaaaacgtaccggtttaggtaccggttaccgtacgttaacccgaaccgttaacgttaccggttcgttaacccgtttacgttaccctttccccggttacccccggttacctttaaacggttccgttacgttaaaccgg

SEQ ID NO: 142997 - DNA, 744 bp, Homo sapiens
  misc_feature: GYAE6OF02H3CWM.46.67.G01.1.454.CMB.1.raw
  modified_base (200)..(200): a, c, t, g, unknown or other
  misc_feature (200)..(200): n is a, c, g, or t
tcagactagcagtacacgaccggtgctcgatttagagtatacatattgggtttggggagtctcggtcaggacacagcatggacatgagggtccccgctcagctcctggggctcctgctactctggcctccggaggtgccagatgtgacatcgagctgacccagtcctccactccctccctgtctgaccaaccggtggganacagtcgtaccaaccatcacgttcggccgggacaaggtccggaactagttcgacctaaccttaatttaagttgtatacaacatagaccgagggaccgaccctagctactatactatgtctgactatccgtagtttagacgtaacgggtcggtaccctagtacggtagttacgtagtcggtacgtaggtagtacgtcggtagggactagtactttacgaaccttacctaccaactacgttacgtaagttaactccggtacgtaccggtaaagttacggtaaacgtttacgtttacgaacctttaagttttactttaacgttacgtaactaaattaaccgttaaatttaaccgttaagttttaccgggtttaaaccggacggttaaacgggtaccctaaactaaaccgtttaaaaccaaacgtttaaaaccggtacgttacggttaccggtacgtaccgtaccttaaccggttaccttcgttacttaacccgtttcccgttacgtttaccccccgttacctaccgtttaccgttatacccggttac

SEQ ID NO: 142998 - DNA, 776 bp, Homo sapiens
  misc_feature: GYAE6OF02H6ING.46.67.G01.1.454.CMB.1.raw
tcagactagcagtacacgaccggtgctcgatttagagtatacatattgggtttgggggacctcctgtgcaagaacatgaagcacctgtggttgtcctcctgctggtggcagctcccagatgggtcctgtccctggtgcaactgcaggagtcggcccacgactggtgaggccttcggagaccctgtccctcacctgcgctgtctcgtggtcgcctccatccaggttaggttcggtttcttcggtggggccgttgggtccggcgacgccgtacccggagggggaacggggtcgtagggaactacgtagttcggtaagttggtcttaccgtacgtaagttacggtagggttacggtttcccttaagtttaccgacgttccgtttccgttactaccgtaaggtacggtccgtagtacctacctaactacgtcgttacgttcggaaccgtaccgtacctacgtacctaactcgttaccgttttccgtacggtaacgtgttagttacgtttcgtacggtacggtaccccggtccgacgtacgaccgggttaccgggtttacggtttacgtttacgttggtcggtaacgtacggaggtaccggtacttagttcgttagtttaggttttacggggtagtttacggttttacgttaccgtaacccgttacccgttaaggtcggtaccgggtaccgggttcccgtacccggtccgggtaccgggtacggtacggtaacgtcggttacggtaccctacccgttcttaccgttccgtaccctacccgg

SEQ ID NO: 142999 - DNA, 882 bp, Homo sapiens
  misc_feature: GYAE6OF02F3BO9.46.67.G01.1.454.CMB.1.raw
  modified_base (703)..(703): a, c, t, g, unknown or other
  misc_feature (703)..(703): n is a, c, g, or t
tcagactagcagtacacgaccggtgctcgatttagagtatacatattggggtttgggggagtctcggtcaggacacagcatggacatgagggtccccgctcagctcctgggggctcctgctactctggctccggagtgccagatgtgactatcgagctcgacccagtcctaccactccctccctgtctcggacaaccggtgggaacgactaggtgtaccaccaattcctaacgttcggacccgggggactaaacgggttacgggaaactacgttacggaaaccttaacccgtttaaattttaaaaggtttcgggttaaacttaaccctaaaactaacggttaaccggaaacccgggaaaccggggggtaaacccccgggtaaccccccttaaaaaggtccccgttaaaccctttaaaacggtttacccttaacgtttcggccccgttaaggacccttaacgttaccccgtaaggtttttaaccggaaccggtaaaacggggtttcccgggggtaacccctaaagggttccggttaacgggtttacgtaaccgggttggggaccgtaaggggttcggtaacgttacggtacgggaaacgttagttacgtttacccacgtttccgtaaccaacgttacaacgtaagttaacgtctaacggacgttaacgtagtaaaggttctttaacgacttaaacttacgttanacggtaaacaacgtattaaacgtaactaggtttcggttaccggaacgtaggtaacctaacggtaaaccttaagtaaaacgttaaacgtaaccttgggtacggtactacgaaccgtaaaccttggttaacttccggtactttacacccgttccctacccgtacgtctttacggactaacg

SEQ ID NO: 143000 - DNA, 717 bp, Homo sapiens
  misc_feature: GYAE6OF02HDPVO.46.67.G01.1.454.CMB.1.raw
  modified_base (217)..(217): a, c, t, g, unknown or other
  misc_feature (217)..(217): n is a, c, g, or t
  modified_base (261)..(261): a, c, t, g, unknown or other
  misc_feature (261)..(261): n is a, c, g, or t
  modified_base (450)..(450): a, c, t, g, unknown or other
  misc_feature (450)..(450): n is a, c, g, or t
  modified_base (500)..(500): a, c, t, g, unknown or other
  misc_feature (500)..(500): n is a, c, g, or t
tcagactagcagtacacgaccggtgctcgatttagagtatacatattgggtttgggggaccctcctgtgcaagaacatgaagcacctgtggtttgtcctcctgctggtggcagctcccagatgggtcctgtccctggtgcaactgcaggagtcgggcccacgactggtgaggccttcggacgaccctgtccctcaccgtgccgctgtctcgtggtcncctcatcagttagttcggtttctcgtggggtcttggggtcccgnacgccgtacccggaggggaacgggtctaggaatacgtagttggaagttctctctctagttggtgggtacggttccttagttacgacggttcccgtctcctacgaagtcgtcgtaacgttccaacctattactcctcgtacgtaacctaccgtccacgactaacttcgttaccgttttcccgagaaagtnttcggtacgtttcgacgttcggacccgtcgtctacggacgtaccgggttnttttaacgtacgtcgttggacgacggtacgtaccgtacgttagttacgtcggttttagtttcgggtaacgtttcggttttacttaccggtaacctacccgtaagtccggtaccgggtccgggtcctacccggggtaacccggttcggggacccgtaaggttacgtaccggttacggtacccgtacccgttacgtaccgttcccgacccgtaccccgg

SEQ ID NO: 143001 - DNA, 735 bp, Homo sapiens
  misc_feature: GYAE6OF02JUTUR.46.67.G01.1.454.CMB.1.raw
  modified_base (198)..(198): a, c, t, g, unknown or other
  misc_feature (198)..(198): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctcgacccagtctccactcctccctgtctcgacgtaaccggtggganacgtagtcgtaccaccattccacttcggccgggactacggtcggaactcgttgaccgtaaccttaatttaaagttcgtacttacaactacgtaacggaaccgacgggtaacccgggaccccttaagggacccttacctaaacttccgtaacgttcggtcgtacgctaactacccgttagtttacggaaccggtaacgggttacggggtacccacggtttacgtaccgttaccgaggttaacggcgtaacggtgtataccggtggacgtaccgttgttaactccgtacctaccgaccttanacccgttagtaacgtagccgtagaccgttagtagttacttacgtactacttacgttacgtagtaacgtaacgttacgtaacgtagtaacgttaggttaccggtaaaccggtaaagtaccgtaagttaaaccgtaaacttaaacgtaacttaaggtacgtacgtacgtcggtaacctaccggtattcggtacgttaccttacgtccgttaccgtccctacgtacttacccgtgtaacg

SEQ ID NO: 143002 - DNA, 804 bp, Homo sapiens
  misc_feature: GYAE6OF02G3BGZ.46.67.G01.1.454.CMB.1.raw
  modified_base (256)..(256): a, c, t, g, unknown or other
  misc_feature (256)..(256): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctaccactccctccctgtctcgacgtaaccggtgggacgactaggtcgtaccacctatcctacgttcggaccgggactaaggtaccggaactnttacgaacctaaccgtttaatttaaacgttggtaactactaaactagtaacgaacccggtaagggacccggtacccctaaggacccttaccgtaaagtccgttatacggtctacgaccttaacgttaccgtaggtttacgaaccggtaaaacgggttccgggtaacccaagttccggttacggttacgtaggtcggacgtaggtacgacgttcggacgggtaactaacggttcctttacacccttacacctaaactactaacgtagtaaccttcggtacgtaacgtaacggtaacgtaagtttactttacggtaacctttaacttttaagtaaccgttaacgtaaccgtaaataaaccgttaattaaaccgttaaggtttaccggtttaccgaaaccggtacggtaaaccgtaaccgttaacttaaaacgttaaacgttaaaaccggttaagtacgggtaccctagaccgtaccgtaaccttaccggttaattccgttaaccttacgttaccttcccgtaccggttactacggttacaacgttacccg

SEQ ID NO: 143003 - DNA, 725 bp, Homo sapiens
  misc_feature: GYAE6OF02HGYBF.46.67.G01.1.454.CMB.1.raw
  modified_base (176)..(176): a, c, t, g, unknown or other
  misc_feature (176)..(176): n is a, c, g, or t
tcagactagcagtacacgaccggtgctcgatttagagtatacatattgggcttgtcctcctgctggtggcagctcccagatgggtcctgtccctggtgcaactgcaggagtcgggcccacgactggtgacggtccttcggagaccctgtccctcaccgtgcgctgtctcgtggtcnccctcatcagtagttggtttctcgtggggctgggtccgcagcctccggagggacgggtctaggaatacgtagtacgggaagttcgtctacgtctaagttaggtaggtacggtttacctaattacgacgttccgttctctacgaagtgtacgagtaccaactattactctcgtacggacctcgtacgacgactaatcgttacgtttcccgagaatacgtgtacgtttctgtccggtaaccgcgtctacggtaaccgtacgggttactttaacgtcgtaggtcgtacggagtacggaacgtcttagttaggtgtttaaggtttgggtagtttacggtttagttaccgtaaccgtaaccgttaggtacgtaccgggtcggggtaccctacccgggtaccggtcggggtaaccacgggtaattaccgggttcggtaaccttccgttaccttaccggttcctacccgttcccaaaccgggtacccggaccttaccggttcccgttcccttccccgtacgttaacccctccccgttaccgtaccgacgtaccccg

SEQ ID NO: 143004 - DNA, 694 bp, Homo sapiens
  misc_feature: GYAE6OF02HRILW.46.67.G01.1.454.CMB.1.raw
  modified_base (250)..(250): a, c, t, g, unknown or other
  misc_feature (250)..(250): n is a, c, g, or t
  modified_base (460)..(460): a, c, t, g, unknown or other
  misc_feature (460)..(460): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggacgaccctgtccctcacctgcgtctgtctctggtcgcctcatcagttgttgtttctgtgggctgggtccgncgctccgagggagggctagaatacagttggaagtgtctctactagtaggtggtacggttcttattacgacgttcctctctactaagtcgtcgtagtacactatactcgtcgtacgtacaccgtaccagactaacttccgtacgttttcccgagtaacgtagtcgttagtttcgtagtaccgccgccgtacgtcggacggttaccgggttnttttaacgttcgttggtcgacggacggttacgacgggttactttaagtttagttagttttacggtttttagggaggttttacggttttacgttaccgtaaccgtacccgtaggtaccgtacggggtccgggtaccgttacccgggtacccgggtacggggaccgtaacgggttaccgttcggttaaccggttaccgtcccgttaccgttcccgttaccgtccccgtaaccccgg

SEQ ID NO: 143005 - DNA, 690 bp, Homo sapiens
  misc_feature: GYAE6OF02GDBEB.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtcctccatccctccctgtctgcaaccgtgggagacagtgcacatcacttgccgggnaagtcggaacattgacaccttaatttaaatggtatcaacatacgacgagggaccgacccctaagctcctaatctatgctgctatcctagtttcgacgtaaacggtcggggtaccctagtacggtaggttacaggtacggcgtaggtggtactggtacggggaacagtactttcgaacttccgtaccaaccgtatacgaagttaactcgtaggacaacggttagtaaagttactttacggtaaccttaactttactttacgtaacgtacaaacgtaagtaaactttaacgtaacgttttccggttttaccggaaccggtaacgggtaacctaacggtaacccttaaaacgtaaaacgtttaaaccgtaaacggttggtacggtacccgttaggaacccctacgtaacgtttcgttacggtttctttaacctaccgtttacccgtccccgtaactaccgttacgtagttaaccg

SEQ ID NO: 143006 - DNA, 705 bp, Homo sapiens
  misc_feature: GYAE6OF02FP8M2.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagcctcccgaggggaacggggctaggaactacagttggaagtgtctctcagtagtggaggttcctattacagtccgtctctacaagtagtcgagtcacgtatatctctggacacgtcagcaatctacgtttccagaagagtgtagttctgtcgaccgccgtcgtcgacgtacggtacgtttacgtacgtgtgcgaaggacgtacggtcttaagtttagtaggttagtttttggagtttagggtttacttccgtaacctacccgttagtacggtccgggtaccggggtccttaccggtacccggtggggacccgtaaggggtaacgttaccgttacggcccgtaacggttccgtacccgtttcggaccccttaccccggaaaccgggtaaccgggtaccccctaaccgggttccccggtttaccccgtttaccccccggttacggtacccccgttaccccccgtaccccgtaaccgtaaccggacccgttaccccg

SEQ ID NO: 143007 - DNA, 597 bp, Homo sapiens
  misc_feature: GYAE6OF02GFIHU.46.67.G01.1.454.CMB.1.raw
  modified_base (238)..(238): a, c, t, g, unknown or other
  misc_feature (238)..(238): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (405)..(405): a, c, t, g, unknown or other
  misc_feature (405)..(405): n is a, c, g, or t
  modified_base (460)..(460): a, c, t, g, unknown or other
  misc_feature (460)..(460): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagttggtttcttcgnggggtctgggtccgcagtcctccgaggggaaggggctggaatacattggaagtgtactctctataggtggtacggttcctattacgtagtccggtcttctcgaagngtcgagtcacatatctgtgacncgtcagcaatctacgttttccctagaagtatgtagtttntgtcgaccgccgtctcgtacgacgggtcgtttatacgttgtgcggagagacggtntattatgttagttttggtagtttagtttagtttaccgtactacccgttagtacgtccgggtacggggctcccggacccggtgggacccgtaggtacgtacgtcggtaccgaccgttcttacccgtcgtcctacccgg

SEQ ID NO: 143008 - DNA, 782 bp, Homo sapiens
  misc_feature: GYAE6OF02F7SG9.46.67.G01.1.454.CMB.1.raw
  modified_base (616)..(616): a, c, t, g, unknown or other
  misc_feature (616)..(616): n is a, c, g, or t
tcagactagcagtacacgaccggtgctcgatttagagtatacatattgggtttgggggacctcctgtgcaagaacatgaagcacctgtggtttgtcctccctgctggtggcagctccagatgggtcctgtccctggtgcaactgccaggagtccgggcccaacgactgggtagacggtccctttcgggacgaccctagtccccctcacccgtgcgtcttgttcctcgttgggtcgtacccttccgaattccgaaggttaggtttcggttttacccttccggtggggggtccttggggggttaccccggctaacggtcccgttacccggaagggggtaaacgggggccttaggggtaaacttaccgtagtttacgggaaacgtttcggtccgtactacgtaagtaggtacggggtaccggttttccaagtttaccgacggttcccgtacttcgtaacgaacgtaggtaccggtagtaccctaaccggtaattacttcccttacggtaggaacctaccggtaaccacgactaactccttaacgttttcccgaagtacgtagtcggttattcggtcgtaccggccgccgtcgtcgacgtacgggttctttaagcttggnacgagacggtacgtactttattagcggttagtttcggtaagttcgttacgtttcgaaccgtaactggtaacgtcgggtaccggctacccgggaccgtgggacccgtaggtaaacgttccggtagtaccccgttaccgtcccgtttacgtacccggccctaacccgg

SEQ ID NO: 143009 - DNA, 669 bp, Homo sapiens
  misc_feature: GYAE6OF02JQRGB.46.67.G01.1.454.CMB.1.raw
  modified_base (195)..(195): a, c, t, g, unknown or other
  misc_feature (195)..(195): n is a, c, g, or t
  modified_base (443)..(443): a, c, t, g, unknown or other
  misc_feature (443)..(443): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgacccagtctccatcctcctgtctgccaaccggtggganacagtcgtaccaccactctacttcggccggtacaaggtaccgaacagttcgactaccttaattttaaagttgtaactacaaacagtaacggaccgacgggtacccggacccctaaggccttaccgttaattccttaagcgtctacgactacttaccgtatttacggaacgttaacgggtccggacctagtaccggtagtacgaggttcggactagtgtacgtacgtaggactagtacttcacgttacncaacgtatcgtaagtacgtctacgactaggattaagttctttagaccttaacgttactacgtacgtactaacaagttaacttacgaacgttttacggtaccgaaccgtacgggttaacaacgttaaaccgtaaactaaacgtaaacgtcgtagtcgactacgtacctacgtagttccgtacgttccgttactccgttaccgtacccttacgtctaacgtcgtaacg

SEQ ID NO: 143010 - DNA, 694 bp, Homo sapiens
  misc_feature: GYAE6OF02JVCVF.46.67.G01.1.454.CMB.1.raw
  modified_base (165)..(165): a, c, t, g, unknown or other
  misc_feature (165)..(165): n is a, c, g, or t
  modified_base (194)..(194): a, c, t, g, unknown or other
  misc_feature (194)..(194): n is a, c, g, or t
  modified_base (333)..(333): a, c, t, g, unknown or other
  misc_feature (333)..(333): n is a, c, g, or t
  modified_base (389)..(389): a, c, t, g, unknown or other
  misc_feature (389)..(389): n is a, c, g, or t
  modified_base (654)..(654): a, c, t, g, unknown or other
  misc_feature (654)..(654): n is a, c, g, or t
tcagactagcagtacacgaccggtgctcgatttagagtatacatattgggtttgggggagtctcggtcaggacacagcatggacatgagggtccccgctcagctccgtggggctcctgctactctggctcgaggtgccagatgtgacatcgagctgacccagtcnccactcctcctgtctgaccaccgtggganacagtcgtcaaccactcaccgttggaccggggtactaacgggttacggaacctgttacgaacctactttaatttaacgttggtaactcgaactatacggtaccgaaggtacccggacctaagctacctaatctatcgcngtactactccgtagtttacacggaacggtcgggtccatcggtaacgtcaggttcgnacggtcacttcggacggatcgttattaccgagttcctaacgacctagtacgttacgtaacgttctacggtaactaacggtagtagttacgtttagaactttaactttagttaccgtttacgtaaactaactaaaggttaacttaccgtaggttttacgggtttaacgaacccggtaaaggtaccaacgttaaccttaaacgtaaaacgttaactcggtcgttacggtatacggacctaacggtattactaccgttaccgtttacnccgtttaccgtccgttaacctcgttaacccgtcgttaacg

SEQ ID NO: 143011 - DNA, 747 bp, Homo sapiens
  misc_feature: GYAE6OF02HIJ2U.46.67.G01.1.454.CMB.1.raw
  modified_base (740)..(740): a, c, t, g, unknown or other
  misc_feature (740)..(740): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgaccagatgtgacatgagctgacccagtctcactcctcctgtctgctaaccggtggagacagtcgtaccacactctacttcggtccgggactaagtacggaactattacggactaaccttatttaaaacgttcggtaatactaaagtaactacggtaacccggaacggggtacccggtaacccccgttaaacggtaccttaaccttaaactttaccgtaacggttaccgtcgttacggacctaaccgttccgttaaggttttaccgaacggtaaaaccggtttcgggggaccccttaggtccggtaacggtttacggtacggttcggtacgtagggttaacgggtacttcggtaggaccgtaagttccgttactactccgtacactatacgtaagtactacgtacgacgtaacgtaggttacttagtttacgtacttaacttattacttagtaacaactagtaacttaagtatttacggttacggaaccgtaggtaacctaactctaaacgtaaacgttaacggaacgttcggttacgacttacggtacctaactacgttacgtacgtttactaccggtactttcccgtacctacctctttaccgnttaaccg

SEQ ID NO: 143012 - DNA, 952 bp, Homo sapiens
  misc_feature: GYAE6OF02IIG2Y.46.67.G01.1.454.CMB.1.raw
  modified_base (181)..(181): a, c, t, g, unknown or other
  misc_feature (181)..(181): n is a, c, g, or t
tcagactagcagtacacgaccggtgctcgatttagagtatacatattgggtttgtcctcctgctggtggcagctcccagatgggtcctgtccctggtgcaactgcagggagtccgggcccacggactggtcgagggcctttcgggagaccctggtccctcacctgccgctgtctctggtancctccatcagttagtcggttttctcggtgggtctacgggtccgactcgcccgtaccggaaggggacgggtacctagggtaactacgtagttacgggaagttcgtctactcgaagtggtacggttacgttacttattaccgacggttcctacctctacgtaagtcgttcgacttcaacccttaagtacttccgttacgtacggaaccgtaccgtaccgacgtacgttaaccgtttacgttacccgtttttacccggtaagtaaccgtacggtttcgtttacgggttacgttcggttaccggggaccccgaccggttacgtaaccgggtaaccgggttaggggtttccttttttagtaaccggttttcggtaccgggacggtaacgggtaccgggtaaccgttcgttttaaacgtttacgtttagttttaagggtttttacggggttaacggttttacgggtttttaccgttaccgtaacccgtttaaccggtaacgggttaacgggttccccgggggtaccgggttaacccgggttccccggtaaccccgggggttaccggggtacccggggttaaacgggttaacccggtacggttaaccgggtttaccccgtacccggttttaccccgtttacccgttaacccggttaccccgtaacccgggtaaccggtaaccccgggtcccgttaacggttccccgggtttacccccgttccccgggtaccgaccccgttacccccgacccggtttaaccgccggtaaccgtacccgg

SEQ ID NO: 143013 - DNA, 757 bp, Homo sapiens
  misc_feature: GYAE6OF02I6BY8.46.67.G01.1.454.CMB.1.raw
  modified_base (386)..(386): a, c, t, g, unknown or other
  misc_feature (386)..(386): n is a, c, g, or t
  modified_base (451)..(451): a, c, t, g, unknown or other
  misc_feature (451)..(451): n is a, c, g, or t
tcagactagcagtacacgaccggtgctcgatttagagtatacatattggggttggggacctcctgtgcaagacatgaagcacctgtggtttgtcctcctgctggtggcagtctcccaggatgggtcctgtcctggtgacaactgcgaggagtccgggcccaacgtagtgggtagacggtccttcgggacaaccccgtggttccccacaccgtgcgactgtactcgtcggtcgaccttaccagttcgtaagtagttcggtttctcgtaggggccgttggggtacccggtacgccttccggaaggggtaacggcgtaggtaaatacgtacgttagggtaagtacggtctaccgtgtaagttagggtggtaaccgttacttagttaacncggttcctcgttacacggtaaagtcggtaacgtacgtaccgtaaccatccgtactcgaggtaccncgttacgagaactaaggttcctaagtttcccgtagaaggtactgtacgtacgtacgcgtaccgtcgtacgtacacggtacggtacttacgtacgtacgaggtacgtaggacgtcgtacgttaattaggttagtttaacgttttaggagtttaggttacgtttaaccgtaactccggtaaagtacgggtacgggtaccgggtaccttacccgggtacccggtacgggtccggtaaggtaaacccgttcggtaaccggttacccgtaccgggttacccgtaacccgttttaccgacccgttaacccgg

SEQ ID NO: 143014 - DNA, 675 bp, Homo sapiens
  misc_feature: GYAE6OF02ICGN6.46.67.G01.1.454.CMB.1.raw
tcagactagcagtacacgaccggtgctcgatttagagtatacatattgggtttggggagtctcggtcaggacacagcatggacatggagggtccccgctcagctccgtggggctcctgctactctggctccgaggtgccagatgtgacatcgagctgaccagtcctccatcctccctgtctgcaccgtggagacagtgtcacatcacgttcggaccgggataaggtcggaactagttacgaacctacctttaattttaaaagtttcggtataaccgtaactaagtaacgaaccgagggaccggtaccccttaagacctacctaatctaatcggcttagcctatccgtagtttcgaacgtaaacggttcgggacctaagtccggtaaggttcgaaggtggaactggttacgacgtcggtaggactaagtactttccgaactcgtacacgacttcgaacgtagtctcgtaacgtacgtagtaagttacgtttacgacgttaattacgttactacgtaactaactaagttaacttaactagttacgtttacggaacgtaacggtactaacgtaacttaaactaaacgttaaacgagttacggtacgacgttacgtaccaacgttacgttactcgtttactacgtaacgttccgtaccgtactacttacgattaacccg

SEQ ID NO: 143015 - DNA, 698 bp, Homo sapiens
  misc_feature: GYAE6OF02FKAHV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagactagtgtcacctatccacttgcccgggtacaacggtcggaactattacgacctaaccttaatttaaagttggtactactaacatagaccgagggaccgacccctagacctactaactctatcgtctgtctactccgttagttcaacgtaacggtcgggtccctagtcggtaacgttcgacggtgtcgaggtgacgtcgtagggaactagttacttacgtacttcctacgactacgtactacgttaactcgtcgtaacgtaagtacgtaacgtttatttacggtaacttaacgttaacttacttaacggtacctaaagtaacgtaatttaaccttaagttcggtttaccggaaacgtaacgggtaccaaacgtaactaaaccgttaaaaacgtaaacgtaccgttaacgtcgggtactaaggtaccctaattaccgttaacgttcctttaccgtttacctacccgtttccctttaccccgagttaaccctccgttattaacccg

SEQ ID NO: 143016 - DNA, 796 bp, Homo sapiens
  misc_feature: GYAE6OF02H01K9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctcgacccagtctccactccctccctgtctgaccaaccggtgggaagacaggtcgtaccaccactactacgttcggaccggggacaaggtaccggaactacttacgaacctaactttaagttttaaagttcggtaataccaaactaagtacggaaccggaacgggggtaaccccgtaccccgtaaagtccttaccgttaaacttccttaagtcggtctacggacctaacttaccgttagtttacgaacggtaaacggggtttccgggtaccctaggttaccgggtaggttacgagggttggaccggttaaggtcgggtactgggtacggggtaaacttcgttaactttaccaaccgttactacctaacctagttacgtaacggtttactcgtacgaaccgtaaagttacggtatttaacgtttacgacttttaacgtttataccgtaaccgtaacttaaacgtaacgttaaacttaacgtacgtttacgggttaacccgaagggtaaacgaccttaacgtaaacgttaaacgtaaacgtaaacgtacgtcgtaggtacctacggtaaccctacctacgtttaccgtacgtttaccctacgtttacccggtacccctttacccgaacgttacttacgttagtaacc

SEQ ID NO: 143017 - DNA, 665 bp, Homo sapiens
  misc_feature: GYAE6OF02JAG8R.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctcgacccagtcctccatcctccctgtctcgacgaaccggtgggaacaccgtagtcgtaccaccatctaccgttcggccgggtacaaggtccggaactnttcgactaacctttaattttaaattggtactactaacaagtacggaccgacgggaccggacccctaagccttaccttaactactatcggctcgactctacctagttcggaccgtaaacggtccgggtacctacgtcgtacgggttacaagggtcggacgtaggtaggtactcggtaggactacgttaccgttataacctcgtaccaacgtactaacgtactaacgtcctagaccgtaagtagtacttacgttcaacgttactagttaccttatacaaagttagtaactttacgagttacgttacggacttaacggctaactaactaacttaaaacgtacctaagtacgtagccctaagtaccctactatcgtacgttacttacgtacttcccgtacctcgtacttccgtaatccc

SEQ ID NO: 143018 - DNA, 767 bp, Homo sapiens
  misc_feature: GYAE6OF02GVP53.46.67.G01.1.454.CMB.1.raw
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagactaggtcgtcaccatcacgttcgccggnaagtcggaacatgactactatttaaatggtatcaacatacgaacgagggaccggaccctaagtcctacctaattctatgcctgactacgttacctaggtttacgaacgtaaacggggttccgggggttacccctagttaccgggtaaggtttaccgtaaggtcgggtacgtagggttacggtacgttccggttaagggggaacctaggttaccttttaccgtaccttaccctaccgtaaccctaagtaccgtaacgttaaatcccgttagaaccgtaacggttaggtaaacgtttacgttttagaacctttaaactttaacgtttacttaaacgttactaaaacgttaacgtaaacgtttaacttaaacgttttcggtttaaccgggaaaccgtaaacgggtaaccgaaaccggtaaccttaaaccgttaaaacgttaaacggtaaccgttaggtacgtaccgttacgacgttaacctaactttccgttacgttacctttaccgtacttaccccgttcccgtacttaaccgttccgtaagttaacg

SEQ ID NO: 143019 - DNA, 603 bp, Homo sapiens
  misc_feature: GYAE6OF02F3EA3.46.67.G01.1.454.CMB.1.raw
  modified_base (193)..(193): a, c, t, g, unknown or other
  misc_feature (193)..(193): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacattgacacctatttaatggtatcaacatagacaggacgcccctaagctcctaatctatgctgcatccagtttgcgaaagtggggtacccagttcgaggttcgagtggcagtggactcgtgggacagtattcactctcaccntcataatctgcaacgtgaagtatttagactaacttattacttacgtacaactagtaacttacaactttagttttaccggacgtaaacgggtacctaacgaaccttaaactaaaactttaaaaccggaaacttcggttacggtaccgtacggtaacctaaccctaattacccgttaggtttaccctttacgtaacctttcccgtttaccccggaccctactttaccgtgttaaccg

SEQ ID NO: 143020 - DNA, 666 bp, Homo sapiens
  misc_feature: GYAE6OF02HBMSI.46.67.G01.1.454.CMB.1.raw
  modified_base (189)..(189): a, c, t, g, unknown or other
  misc_feature (189)..(189): n is a, c, g, or t
tcagactagcagtacacgaccggtgctcgatttagagtatacatattgggtttggggagtctcggtcaggacacagcatggacatgaggtcccgctcagctcctggggctcctgctactctggctccgaggtgccagatgtgacatcgagctgacccagtctccatcctcctgtctgcaaccgtggganacagtgtcaccattcacttggccggcaaggtcgaactattgactaccttatttaaacgtggtactcgaaacagtaacgaccgagggtaccggacccctaaaggccttaccgtaaactcttaactcgtacctagaccgtatcccgtaaggttttagaccgtaaaaggttcgggtaccccagttccgaaggtttcacgtcggcaggtcggatccggagggtaacacggttactttaccaccttctaaccgtaaccattaacgaagttaactcgtacggtactaaacggtgtaaagttcttttacgaacgttaaactttacttacgtacgtaacaaactagtaaacttacgtaagtttcgtttacggacaacgggtacaacgtactaaacgtaaactaaacgaatcggtagcctaggtacctaacgtattaccgtgtacctttagaccttcccgttcccggaaccttacgttcctagtac

SEQ ID NO: 143021 - DNA, 729 bp, Homo sapiens
  misc_feature: GYAE6OF02HMUNR.46.67.G01.1.454.CMB.1.raw
  modified_base (136)..(136): a, c, t, g, unknown or other
  misc_feature (136)..(136): n is a, c, g, or t
  modified_base (662)..(662): a, c, t, g, unknown or other
  misc_feature (662)..(662): n is a, c, g, or t
  modified_base (675)..(675): a, c, t, g, unknown or other
  misc_feature (675)..(675): n is a, c, g, or t
  modified_base (701)..(701): a, c, t, g, unknown or other
  misc_feature (701)..(701): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtnccagatgtgacatcgagctcgacccagtcctccactccctccctgtctcgaccgaaccggtgggagtacgtaggtcgtaccacctatacctaccgttcggacccgggtacgtaaacggtaccggaactacgttacgaacctaacctttaagttttaaacgttggttaactaacaactagtaacggaaccggacgggtaccccggtacccctaagtcctacctaatctagtcgactcgtactacgtacgtagttcgaacgtaaggttcgggtacccagtacggtagttacgagttgacgtaggtgactcggtaaggactagtcttaccacgttccacacctagttacgtaagttactcgtagtaacgtacggttacgttaaagtttacgttaacgtaaccgttaaacgtttacgtaacgttacgtaactaacgttaacgttaaacttacttacgggtttacgtaaccgtacggaacgtaccgtaaacgtaactaaacgttaaacggttaaacgtagtacggtaacgngttaccgtaaccncggttacttccggtaacttcgttacnccgttacccgtcccaatccgtatcgtac

SEQ ID NO: 143022 - DNA, 771 bp, Homo sapiens
  misc_feature: GYAE6OF02I6CBV.46.67.G01.1.454.CMB.1.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggagaccctgtccctcacctgcgcttgtctctggtgcctcatcagttagtgtttcttcgtgggtctcgggtaccgnagcctaccggaaggggacggtcgtaggaactacgtattagggaatcgtctccgttacagtggtaggtacgtttacctatactacggttcctacttccanaagtcgtcgactcacctatctctcgcggacacgtcacgactatcttaccgtttaccagaactgttacgtagttctaggtaccgaccgtccgtgtaccgtaacggtacgggtttacttttacgtacgttgggaacgtcggacggtacgggtacgtactttaacgttcggtacggttttatttacgggtaacgttttacggtttaacgtttacccgaacttaaccgttacggttaacggtaccggggtaccgggtaccggtaccccggtaccgggtacggggtaaccggaacgggttaaccgttacgttacccggttaccgtacccggttccgttacccgttacccgtcccgttaccgaacccggtaccgggtaccccttacggttaccccgttccccgttacccgtacccggtacccttaaccccgtacccgttaaccgaccggttaccgtaaccccgg

SEQ ID NO: 143023 - DNA, 776 bp, Homo sapiens
  misc_feature: GYAE6OF02GD2EV.46.67.G01.1.454.CMB.1.raw
tcagactagcagtacacgaccggtgctcgatttagagtatacatattgggtttgtcctcctgctggtggcagctcccagatgggtcctgtcctggtgcaactgcaggagtcggccacgactggtgaggtccttcggacgaccctgtccctcacctgcgctgtctcgtggtcgcctccatcagttagttggtttctgtggggctcggggtccgcagcctcccggagggggaagggtctaaggaactacgtagttagggaacgttcggttcctctacgtaggtaggttcggtaacggttttcctaagttaccgtacggttcccgttctaccgtacgtaaaggtacggttcgacgtacccaaccgtagttacgtccgttcgtacggaacctaccggttaccaggaccttaaagttccgtttaccgttttaccgaaggtaacgttcgttacgggtatttcgacgggttaccgaccggtccgtacgtacggtaacggtaccgggtttactttacttacggtcgtacggtaacggtacggtaacggtacgtacttaacgtttaggttaggtttaggttttacggtagtttacggtttacgttaccgtaaccgttaccgttaagtaccgggtcgggtacccggtcgtacccggtaccgggtacgggaccgtagggtacgtacgtcgtccgtacgttccgccgttaccgcctacgaccggccggtacctaccggtccgttacctcccgacggtccctaccggtacctcggaaccgtcctaccgg

SEQ ID NO: 143024 - DNA, 768 bp, Homo sapiens
  misc_feature: GYAE6OF02F69H2.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcccttcggagaccctgtcccctcaccctgcgctgtctctggtncctccatcagtagtggtttcttcgtggggctgggtccggcagcctccgagggtaagggctggaatacattggaagtgtctcgtcatagtggtagttcctattacacgttccgtcttctacaagagtcgagtcaccatactctcgtcgacacgtccagcaatcttacgtttccctagaagtactgtacgtttctcgtcgacccggccgtcgtacgacgtacgggttcgtttacgttacgttggttcgtacggaaggtacggtaccgggtacttaagtttacgttaggttaagttttttcgggtaagggttttagggttttaaccgttttaccggtaaacccgttaaacccgttaagggttaaccggttacccgggggtacccggggggttaccccgttaccccggggtaaccccccggggttaaccggggggtaccccgttaaacggggggtaaacctttaacccggggtttaccgggttaccccggttaacccccgggttttaccccggttacccggttttaaccccggtacccccggtttaaacccccccggg

SEQ ID NO: 143025 - DNA, 834 bp, Homo sapiens
  misc_feature: GYAE6OF02IFU0A.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagttgggcccagactggtgaggccttcggagaccctgtccctcacctgcgctgtctctggtgcctcatcagtagtggtttcttcgtggggcgtgggtccggcagcctcccgaaggggaagggctaggaatactagtggaagtgtctctacatagtggacggttcctattacgacgttccgtctactacgaaggtacgtacgagtaccaaccctattacttccgtacgtacggtacctaccggttaccaacggactaacttacgttaacgtttttccccgaagtaaaggtattacggtaacgttttccggtcggttaccggaacccgtccggtaccgttacggaacccggtaacgggtttaacgtttttaacgttaaccggttgttacggtacggaacggtacgggtaaccgttaacgtttaagttagttaagttaggtttttagggtaggtttaggttttacgttaccggtaaacctaaccgttacgtacgggttaaccggggaccgggggtacctacccggtaaccccgggttggggacccggtaaggtaaccgtcggtacggttacccgtacgttacccgttccgttaccgtacccgtaaccgtaacccggtaaccgggtacccgtaccggtttcccggtttacccccgttaccccggttacccgggtaccccttacccccggttaaccccttaacccgggtaaccggtaccttaacccccggg

SEQ ID NO: 143026 - DNA, 698 bp, Homo sapiens
  misc_feature: GYAE6OF02F5SVW.46.67.G01.1.454.CMB.1.raw
  modified_base (201)..(201): a, c, t, g, unknown or other
  misc_feature (201)..(201): n is a, c, g, or t
  modified_base (682)..(682): a, c, t, g, unknown or other
  misc_feature (682)..(682): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatcgtgacatcgagctgacccagtctccactcctccctgtctgacctaccggtgggacgtacngtctaccactagtcctacgttcggccggtacgtaaggtccggaactgttacgacctaaccttaagttttaacgttgtaacttacaactagtaacgaccggacggaccggacccctagccttacgtactacgtatcggtctgacctactacgttagttcgaacgtaacgggtccgggtacctacggttccggtaagttccgagggttacgcgttagggtacgtaagttccgggtaacggtataacgtaaccgtttccgaccttcgtaaccacgttactacgttaacgtactacgtacgaacgttacggtaagtaacgttattacggtaacttaacgttacttacggttacaactaacgtacttaagttacttacgtttacgtacgtaggtacgaacgtaacctaacgttaactaaacgtactacgtagttacccagtacgacgtactctaccttcgttactccgttcttcccggtaaccctnttaccgtagtcttacg

SEQ ID NO: 143027 - DNA, 925 bp, Homo sapiens
  misc_feature: GYAE6OF02IAJEH.46.67.G01.1.454.CMB.1.raw
tcagactagcagtacacgaccggtgctcgatttagagtatacatattgggtttgggggagtctcggtcagggacacagcatggacatggagggtccccgctcagctcctgggggctcctgctactctggctccggaggtgccagatgtgacatcggagctcgacccagtcctccactccctccctgtctcgacgaaccggtggggacgacgaggtcgtcaaccactctaccgttcgggcccgggacaaggtaccggaactagttacgacctaaccttaatttaagttggtatacaactagtaacgaccggacgggaccggtacccctagacctacctatcgtatcgtcctgtacctactaccgtaggtttaccgaacggtaaacgggttcgggggtaccctagggtaccggtaacggttccgagggtcgggacgtacggttacgggtaacggtacgggtacggggtaacgttaacggttaaccgttttcctaaccgttacccgttacccgtaaccgttaaaccgtttaccgtttaaaccgtaacgtttacccggtaacggtaaaccggtaaacggggtttaacgggttaaaagttttacgttttacccggttaaaccgtttaaacgttttaaaccggtttaaccttaaaccggtttaacctaaaacgtttaaacgttaaaacggttttaaccttaaacgggttttaccggttttaaacccgggaaaccggttaacggtaaacccgtaacccgttaaaccgttaaaaacgttaaaccggttaaaaaccggttacggttacggtaccgtaccgttaaccgtaccgtaaccgttaccgttaccgtttaccgtttaccgtttaaccgtttacccgttaccccggttacccgttaaccttaccggttttaacccgtacggtttaaaccgg

SEQ ID NO: 143028 - DNA, 605 bp, Homo sapiens
  misc_feature: GYAE6OF02I50ET.46.67.G01.1.454.CMB.1.raw
  modified_base (137)..(137): a, c, t, g, unknown or other
  misc_feature (137)..(137): n is a, c, g, or t
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
tcagactagcagtacacgaccggtgctcgatttagagtatacatattgggtttgggggacctcctgtgcaagaacatgaagcacctgtggtttgcctcctgctggtggcagctcccagatgggtcctgtccctggtncaactgcaggagtcgggcccagactcggtgaggcctttcggagacccctgtcccctnacctgccgcttgtctctggtnccctcgatcagtagtggtttcttcgnggggctgggtaccgnagtccncccgagggagggctggatacattgatgtntcnatagtgacggttcattacgagtccgtctcgttcaaggtactcgagttccaacctatacgtctacctcggactacgtccagctaacnctaacgtttttcccgngaaagtatggactttcgctcgaccgtccggactaggacgtagggttactttacttacgtgtcgcgtaggacgacgtcctattagtgtagttttcggagttgtttattcgacgttaccctagtacgttggcgggtcgtccgtacccgttggggaccaagggttaactcggttccgtacgtaacccggttctaccgttccggccctacccg

SEQ ID NO: 143029 - DNA, 681 bp, Homo sapiens
  misc_feature: GYAE6OF02IJUF9.46.67.G01.1.454.CMB.1.raw
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagttggtttcttcgtggggctggggtccgcagcctccgagggagggctagggaactacagttggaagtgtctctcatagtggtagttcctattacacgttccgtctctanaagtgtcgacgttcacctatactctcgtcgacaccgtccagactaatcttacgtttcccngtaacgtatagtacgttcgtacgtcgacccgccgcgtacgacgtacgggttactttaagttacgtgtcgacgtaaggacggtaacggtacttaagttagtgtttagttttacgggaggtttaggtttacttacgtaaccgtaccgtagtacgtaccgggaccgggtacgtcccggtacccggtacggggaccgtagggtaactacgtacgtccgtaccgttcccgttaccgtacgcccgtaccgaccggtaaccggtaccctacgttacccggttcccttccccggtcggtaccccgttacccgtaccctacgaccgaccgtacccgg

SEQ ID NO: 143030 - DNA, 689 bp, Homo sapiens
  misc_feature: GYAE6OF02H0DZJ.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggccttcggagaccctgtccctcacctgcgctgtctctggtgcctccatcagtagttggtttcttcgtggggcttgggtccggcacgctccgaggggaaggggctaggaatacgtagttagggtaaggtgttcgtctcgtataggtggtaggttcctattacacggtccgtctctacaagtacgtcgtagtacaccatactctcgtcgacaccgtcaagtcaatcgtacgttttccctaggaacgtagtcgtagtttcgtggtcggacccgccgtacgtcgtaacgtaccgggtacgttttagttacgtagttcggcgaaggacggtaccggtacttagtttagttaggttagtttttagggtagttttaacgggtttactttaccgaaccgttacccgttaggtacgtaccggggtacggggtaccgtccgggaaccccggttcggggaccgtaaggggtaactaccggttcggtaccggttacccgttaccgtaccgttccgtaccctaaccccgg

SEQ ID NO: 143031 - DNA, 712 bp, Homo sapiens
  misc_feature: GYAE6OF02G3QAU.46.67.G01.1.454.CMB.1.raw
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatggtgacatcgagctgacccagtctccatcctcctgtctgcaaccggtggganacngtgtcaccatcacttgccggganaggtcgaacattgacaccttaatttaatgtatcaacatagacgagggaccgccctaagctcctaatctatgctgctactccgtagtttagacgaaacggttcgggtaccctagtcggtacggttacgaggtggacgtaggtcggtacgtcgtcgggaacacgttacgttacaccgttctaccgactacgtactagttaactcgtcgaacgtacgtaaggtaagttactttacgtacgttaaactttacgtttaacgttaccgttaagtaacgtaaacgttaacgtttaaccgttaacgttttacggtttaccgggtaacccggttaaacgggtaaaccgtaacggttaaaccttaaaccgttaaaacgtttaaaacccgtaagtaacggttcgggtacctacggtacctaaccggttaacttaccgttacgtttaccgttacccgttaaccgtttacccgtttacccgcccgtaacttacgttacttaaccgg

SEQ ID NO: 143032 - DNA, 726 bp, Homo sapiens
  misc_feature: GYAE6OF02IHIMH.46.67.G01.1.454.CMB.1.raw
  modified_base (173)..(173): a, c, t, g, unknown or other
  misc_feature (173)..(173): n is a, c, g, or t
  modified_base (196)..(196): a, c, t, g, unknown or other
  misc_feature (196)..(196): n is a, c, g, or t
tcagactagcagtacacgaccggtgctcgatttagagtatacatattgggtttggggagtcgtcggtcaggacacagcatggacatgaggtcccgctcagctcctgggctcctgctactctggctccgaggtgccagatgtgacatcgagctgacccgtagtctccattcccnccctgtcctgcaaccggtggganactagtcgtacaccatcacgttgccggtacaaggtccggaactacgttgacctaacttaatttaaagttcggttatcgaaactagtaacgacccgtaagggtaccgaccccctaagaccttaccgtaattccttaagtcgcttagacgtactcctagtttacgacgtaaaggtccgggtacccagtccgagttcgagtggactagtagatcgtagggactagtatttacgactaccgtacacccgtaataccagttaaacgtctacggtctaaacggtacgtaaaggttatttaccggtaccttaaactttacgttaacctagttaaaccgtaaacaaacgttaaagttaccttaaagttcgttttaaccggtaacccgaaagggtaacccgtaaacgttaaccgtaaaccgttaaaaagtaaaccgttaaaacggtcgttaacggacccgtagtaccctaacgaaccgttgttaaccgtacgtttctaacccgttcttaaccccggacctaacgttccgtagttaaccc

SEQ ID NO: 143033 - DNA, 706 bp, Homo sapiens
  misc_feature: GYAE6OF02I7FZX.46.67.G01.1.454.CMB.1.raw
  modified_base (198)..(198): a, c, t, g, unknown or other
  misc_feature (198)..(198): n is a, c, g, or t
  modified_base (409)..(409): a, c, t, g, unknown or other
  misc_feature (409)..(409): n is a, c, g, or t
  modified_base (637)..(637): a, c, t, g, unknown or other
  misc_feature (637)..(637): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctcgaccaacggtgggaanacagtgtaccacctatccgtacttccggccggtactaaggtaccgggaaactacgtttacgacctacctttaattttaacgttggttaactacaaactagtaacgaaccgagggaccgtaccccgtaagcctacctaatctaacgtcggctagacctacttaccgtaagtttgaaccgttaagggtccgggtcccacgtcggtaggttacngggttacgacgtaggtacgtagttcggtacggaacttagttactttacgaccttacgtaaccacgttaactacgtaacggtttaactgtaccggtaaccgtaaagtacgttaaagttactttacgaacttaacgttactaacgttcgtacaagtacgttaacttacgtagtttacggtacgaacgtacggtacacggttaactaagttaaactaagtacgtgtaacgntaccgactacgtacttcgcgtttaacctcgtaccgtttccgacccgttcgtaacgtccgtattaacccg

SEQ ID NO: 143034 - DNA, 594 bp, Homo sapiens
  misc_feature: GYAE6OF02FXZPH.46.67.G01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtgtttctcgtggggctgggtccgnagcctccgagggagggctggatacagttggagtgtctntcatgtggtagttcctattcacggtcctctctacaagcgtcgagtccacatctctcgtcggctacgtcagctaatcgtacgttttcccaggtaatacgtgtactttcgttagtcggacccgtccgtctcggaccggtaccgggttcgtttattacgttggtcgcgagtacggcgtactagtttatggttagttttggagtttgtttacttacgacctacgtagacgtcgggacgggtccaccggtcccgggcggtaccggagggtactcggtcgttacctccgttcttaccgttacgccctaacccgg

SEQ ID NO: 143035 - DNA, 768 bp, Homo sapiens
  misc_feature: GYAE6OF02JVBFG.46.67.G01.1.454.CMB.1.raw
  modified_base (224)..(224): a, c, t, g, unknown or other
  misc_feature (224)..(224): n is a, c, g, or t
  modified_base (486)..(486): a, c, t, g, unknown or other
  misc_feature (486)..(486): n is a, c, g, or t
  modified_base (545)..(545): a, c, t, g, unknown or other
  misc_feature (545)..(545): n is a, c, g, or t
  modified_base (761)..(761): a, c, t, g, unknown or other
  misc_feature (761)..(761): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctcgaccctagtctcctactccctccctgtctcgaccgaaccggtgggaacgacacggtcgtaccaaccgntcacgttcggcccgggactaaggtaccggaactagttcggaacctacctttaatttaaagttggtaactacgaaactgtaacggaccgtaacgggtacccggacccctaagtcctaccgtaactccgttatcgctacgactaccgtaacgtcgtttaacgacggtaacggttccgggtaccacggtaccgggtaggttaccgaggttcgggacttaggggtagacgttcggtacgggacgttaacggtctttaaccgtaccncttaccaaacccgtgttaccgtaagtaactcggtactaacgggtaactacgtaagtttnttaccggtacttaaccgttattaccggttactaacaaaacttacgtaaactttaaccggtattttacggttacccggaaggttaacccgggaaactttaaacccgacgttaaaaacgttaaacgtaagtaaacccgtgtaaccgcgtaacgtacgtacttaaaccttggttaacccttacgtccgttaactcccggttaccacgttaccggtactnttaaccg

SEQ ID NO: 143036 - DNA, 763 bp, Homo sapiens
  misc_feature: GYAE6OF02GP8F0.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtctccatccgtccctgtctagacctaaccggtgganacagtcgtccaacctatcctacgttcggacccgggtactaacggtaccgggaaactagtttacgaaccgtaacctttaaagttttaaaacgttcgggttaacttaccgaaaacctagttaacggaaccgaacggggtaaccccggtacccccttaaaggccccttaaccgttaacttaccgttacgtacgtccgtacgtactacgttacctaggtttacgaacgtaaacggggttccgggtaccctaagtcggtacggttgaacggttggaccgtaaggtcgtagtcggtaacgggactaaggttctttacaacgttacctaccaacttatacgtaaggttaatcgtagacgtaaacgtagtaaagttatttcgtaacctaagttacttactacgtaacctaataagttaaacttagttaacgtttacggttccgaaaccggtagggtaaaccctacgtaaaccttaaacggtaaacttaaacggtacgtggtacggcttaacgccgttaactaacgttcgttataccttactaccgtccgttaccgtactgtaccgtagtacg

SEQ ID NO: 143037 - DNA, 759 bp, Homo sapiens
  misc_feature: GYAE6OF02JT4C2.46.67.G01.1.454.CMB.1.raw
  modified_base (169)..(169): a, c, t, g, unknown or other
  misc_feature (169)..(169): n is a, c, g, or t
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
  modified_base (385)..(385): a, c, t, g, unknown or other
  misc_feature (385)..(385): n is a, c, g, or t
  modified_base (464)..(464): a, c, t, g, unknown or other
  misc_feature (464)..(464): n is a, c, g, or t
tcagactagcagtacacgaccggtgctcgatttagagtatacatattgggttcggggacctcctgtgcaagaacatgaagcacctgtggtttgtcctcctgcgtggtggcagctcccagattgggtcctgtccctggtgacaactgcgaggagtcgggccagactggtnaggccttcggataccctgtccctacgaccttgaccgtntcgtccgtcgtggtcgcccttcactttccgaggttaagttcggtttcttacggtggggtccttacggggttcccggntaaggtcctacccggagggtaaggggtccgtggtaactacgtagttacggtaagttcggttcctacgtcgagttaggtcgggtacggttacttagttaccnggttccgtctcgttacagtagtcggctacgacctgttactcgtcgtgaccacgtcgagtacagttctaacgttttaccnggtaacgtacgtacgtacgtttacgtagtaaccggccgtaccgtacgtccgaaccggtaaacggttccgtttaaaccgttcgtacggttacggtaccgaagggtaccggtacgtacgttacttagttacggttatttacgggtagttacggtttaccgtttacgccgttaaccgtaacgttaccggtacgggttaccgggtccggttaaccggtaacccggttacgggaccgtaaagggtcgttaacggttcggttaaacccgtcgttccggtaaccgttcgtaccccgtaacgg

SEQ ID NO: 143038 - DNA, 817 bp, Homo sapiens
  misc_feature: GYAE6OF02G51FC.46.67.G01.1.454.CMB.1.raw
  modified_base (94)..(94): a, c, t, g, unknown or other
  misc_feature (94)..(94): n is a, c, g, or t
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (319)..(319): a, c, t, g, unknown or other
  misc_feature (319)..(319): n is a, c, g, or t
  modified_base (333)..(333): a, c, t, g, unknown or other
  misc_feature (333)..(333): n is a, c, g, or t
  modified_base (443)..(443): a, c, t, g, unknown or other
  misc_feature (443)..(443): n is a, c, g, or t
  modified_base (573)..(573): a, c, t, g, unknown or other
  misc_feature (573)..(573): n is a, c, g, or t
  modified_base (586)..(586): a, c, t, g, unknown or other
  misc_feature (586)..(586): n is a, c, g, or t
tcagactagcagtacacgaccggtgctcgatttagagtatacatattgggtttgggggacctcctgtgcaagaacatgaagcacctgtggtttntcctcctgctggtggcagctccagatgggtcctcgtcccgtggtcgacaactgcgagggacggtccgggccctacgacgttgggtacgacggtcccttcgggaacgtaccccgttcgtcccctnaccgttggccgcttcgtctcgttgggtcnccctcatctaggtgttgtttcgtacgnggggcttgggccgnacgtccgtccgaggggacgggtctaggaacncgtattaggtagtntctactacagtaggtgtacgttactacgttacgtacgtcctcttcgtaacgagtaccggtagaccttacgaaccttagtctacgtccggttaacgaccgtactaccgaanaccgttaaacgtcgttttaaccgtttaaccgacgaagttacgtcggttaacgttgtaccggttcgaacccggccggtagttaccgtaacgggtcgtttacgggtttacctgttaaggcgaacgggttaanccggtaacgtttntaacgttacgttggttttaacggttttgaccggttttacgggtttaaccttaccgggaacccttaaccgttaggtaacccggggccgggtttacccggggcgtttaccccccggggtaccgggtaaccggggtaacccgttaagggtacccgggtttaaacctttcccggggttaccggtaacccctttccccggggtttaaactttccccgggacccgttaaacccgggg

SEQ ID NO: 143039 - DNA, 709 bp, Homo sapiens
  misc_feature: GYAE6OF02G9EAL.46.67.G01.1.454.CMB.1.raw
  modified_base (412)..(412): a, c, t, g, unknown or other
  misc_feature (412)..(412): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcgaggtagtcgggcccagacgtggtgaggtccttggacgtccctgtccctcgaccgtgccgtcgttgtcctcgtggtcgccctcactccgtaagttcggttcgttttccttcggtggggtccgttggggtccccggacacgcccgttaccggaagggggtacgggtactaggaacgttacgtagttacggggaacttcgttcctacgtacgtagttacggttcgggacgttttacctttaagtactccggtttacccgtactccgtaanaaacggttggtacggtaacttcccacttaagttccgtctaacgtcggtactaccgtgaactactaacttcgtaccgtttcaggtaagtcgtattaacgtcgtcgtaccgcgtccgtcgtacgtaccgtagggttactttacgtcggtatcggtagacgtcgtacggtacttagttagtgttaacgttgttacggttatttcgttacgacctcgagtcgtcgggtccggacgtccgacgggtccgaaggtacggtacttacggtcgaccttcgtacccttcgtaccgtacgtaacccg

SEQ ID NO: 143040 - DNA, 782 bp, Homo sapiens
  misc_feature: GYAE6OF02GG4MG.46.67.G01.1.454.CMB.1.raw
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtgcagctcccagatgggtcctgtccctggtgcaactgcaggagtcggcccacgactggtgaggccttcggacgaccctgtccctcacctgcgctgtctcgtggtgcctcatcagtagtcggttctcgtgggctgggtccggnacgtcctacccggaggggaacgggtctaggaactacgtagttggaactgtctctgaagtaggtggtacgttacctagttaccgacgttccgtctcctacgaaggtacgtacgtagtaccaacctaagttctaccgtcgtaccggtaacctaccggtaccaggaaccttaacgttccgtttaaccggttttcccgaagaacgtcgttacgttagttccgtaggtccgaccggtaccgtcgtacgtaaccggtacgggtttacttttacggtaccgttggtaacggacggtaacgtacggtacggttacttaacgttagttacgtttaggtttagggtaggtttacgtttacgttaccgtaaccgtaaccgttaggtccggtccgggtaacggggtcccttaccgggtacccgggtaggaccgtaagggtacttcggtaccgtaccgttacccgttacgttccgtaccgtacccgtaaccgaaccggtaaccgggtacccttacgggttcccccgtttacccgttccccgtaccgtccccttaaccccgtacccgtaaccgtacggtaccgtcccg

SEQ ID NO: 143041 - DNA, 893 bp, Homo sapiens
  misc_feature: GYAE6OF02IED2S.46.67.G01.1.454.CMB.1.raw
  modified_base (170)..(170): a, c, t, g, unknown or other
  misc_feature (170)..(170): n is a, c, g, or t
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctcctanccttcctgtctgccaacggtggganacagtcgtcaccatcncgttcggccgggactaacggtacggaactattcgaacctaacttagttttaaaacgttggtaactaccgtaaactaacgtaacggaccgaacgggggaccccggtacccccgttaaggcccttaacccgtaaatttccgttaagttcggccttcggtacctagttcccgttaggttttacggaccgtaaaacgggttcgggggtacccctaaggttaccggttacggtttcgaacgggttcggaccgttaaggggtggtaacgttcggtcggggtaaaccgtaacgttaccgtttaccgtacctttacctaacccgtaacctaacgttcctaaacgtttaaaccgttcgtaccggtaccggttaaacgttaagggttaacgttttaacgttttacgtaaccgttttaaacgttttaacgtttaccgttacggttaaacctaaacgttaaacgtttaaaccgttaaacgtttaagggtttaccggtttttaacccgggaaacgttaaacgggggtaaccctaacggttaaacccttaaaacgttaaaaaccggtttaaacgtaaccgtttcggttaaccgtcgttaaccggacgtaaacccttacgttttaccgttcgttttaaccctacgttacccttttacccgggtaccccttacgtaacctttccggttaccttaacgg

SEQ ID NO: 143042 - DNA, 579 bp, Homo sapiens
  misc_feature: GYAE6OF02FHXNM.46.67.G01.1.454.CMB.1.raw
  modified_base (346)..(346): a, c, t, g, unknown or other
  misc_feature (346)..(346): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaattggtatcaacatagaccagggaccggcccctaagctacctaatctatgctgcatccagtttgcaagtgggtccatcgagttcagtgcagtgatcgtggganagattcactctcactatcagtatctgctaacgtgtaagtatttagactaacttattacgtgtacaacgtagtaaattactaagttacgttttacggaccgtaaagggtaccaacgtacttaaacctaaaacgtttaaaaccgaacgttaggtacggtacgtcgaccgtaacctactaccgtacgttaccttactacttacccgttaccccgtacctacgttcctagttaaccg

SEQ ID NO: 143043 - DNA, 674 bp, Homo sapiens
  misc_feature: GYAE6OF02GTDPS.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcctaaccgtgggagacagtcgtcaccatcacttgccggganaagtcggaacattcgactacctaatttaaatggtatacaacatagaccgagggaccgcccctaagctacctaatctatgctgcactccgtagtttgacgtaagggtcgggacccctagttaccggtaggttcgaggttcgggtactaggtaggtacttcgtacggggaaccgtagttactttactacttccgtaccaaccgtaacgtctaaggttaactccgtagaaccttaacggtagtaacgttgtttacgaccttaaaccgtttagttaaccgttagtaaccaaacgttaagtaaacttactaacgtttcggtttaccggaaccgtaacgggacttaaccggaacttaaaccgtaaaattaaaccgacgttacgtcggacttacgtccaaccgtatttcgttaccgtacttaccgtacctcccgttacccgaccttatccgttagtaac

SEQ ID NO: 143044 - DNA, 776 bp, Homo sapiens
  misc_feature: GYAE6OF02JYAX9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcggaggtgccagatgtgacagtcgagctcgacccagtcctccactccctccctgtctcgaccgaaccggtgggagacagtcgtacaccactcacgttcggccggacaacggtaccggaaactacgttacgaacctaaccttaagttttaaaagttcggttaactacgaacaagttacgaaccggaacgggaccgtaccctaagtccttaccgtaacttacgtactcggactcgacgtaccttcgtagtttacgacggttaacggtcgggtaccctaggtcggtacggtactaggtacggacgtaggtaggtacgtacggtagggaaccttaaggttacttaccgaccttaccgtactaaccgtattaaccgtacgttacgttcgttaacgacgtaaacggttataaacgtttatttacgactttaacttacttacgtaactaaacgtacgaaatttaacgttaacttacggtttaccggtttcggaaccggttaaacggtacctaaaccgttaaaactaaacgtttaaaacgtaacgttaaacggtcgtaaccgttagtaacccgtaacgtaaccgttcgttaacgttccgtttaccgttaccttacccgttcccggtacctaccgtttacggttactacgttaacccg

SEQ ID NO: 143045 - DNA, 690 bp, Homo sapiens
  misc_feature: GYAE6OF02IEQM0.46.67.G01.1.454.CMB.1.raw
  modified_base (98)..(98): a, c, t, g, unknown or other
  misc_feature (98)..(98): n is a, c, g, or t
  modified_base (192)..(192): a, c, t, g, unknown or other
  misc_feature (192)..(192): n is a, c, g, or t
  modified_base (306)..(306): a, c, t, g, unknown or other
  misc_feature (306)..(306): n is a, c, g, or t
tcagactagcagtacacgaccggtgctcgatttagagtatacatattgggtttgggggagtctcggtcaggacacagcatggacatgagggtccccgntcagctcctggggctcctgctactctggctccggaggtgccagatgtgacatcgagctgaccagtctccatcctccctgtctgcaacgtggganacagtgtcaccatcattcggccgggcaaaggtcggaaccattgaaccaacttatttaaaagttggtatacaacataagaccagggaccgacccctaaagctacctaatcttaangctgcatcctagtttagcaaaaggttcgggtacccagtacggtacggttctaaggtggacagtaggtaactcggtagggacctagtaacttcgaactctcaaccgtatcaataactcgtacgcgtaaacgtaggtaaatagttttacgaactaacgtttaacttaacgttacgtaacctaaacgtaaagttaactttaacgtaaacgtttcggttttaacgggaaacctaaaacgggggtaaccctaaacgtaaacgttaaaacctaaaacgtttaaaaccggaaacgttaccggtaggtactaccggtaccgtaacctaacgttcttacggtttacttaaccgtccttaccggttccccgtaaccgttaagtccttaggtaac

SEQ ID NO: 143046 - DNA, 618 bp, Homo sapiens
  misc_feature: GYAE6OF02JOCZS.46.67.G01.1.454.CMB.1.raw
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcacgtgganacngtntcacntcatgccggnagcggaacntgacactatttaacgtgtactnacatacgacgaggaccggcctagctcctatctatgctgctatccgtatttagacgtaagggtcggtacctagtaccggtaggttacgaggtcggacgtacgtggtatccggtagggaactagtactttcgactcgtacacctagtctaacgtatcgacgtaactacgtacgtaaacgtgtttacgaactaactttatacttagtaaccgactaaagtacttaagtactttagttaccggacgtaaacgtaccgaagtaacctaaagtaaaccgttaaaccgaagttacgtacgtagaccgtacgaacctactttaccggtacttaccttacgtaccttaccggttacccctacggacctttaccgtagttaacccg

SEQ ID NO: 143047 - DNA, 723 bp, Homo sapiens
  misc_feature: GYAE6OF02G55FO.46.67.G01.1.454.CMB.1.raw
  modified_base (208)..(209): a, c, t, g, unknown or other
  misc_feature (208)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtgggctgggtccggnngctccgagggacgggctaggaatacagttggaagtgtctctcatagtggtacgttctattacagtccgtctctcaagagtcgagtcacctatactcctcgtcggacacgtccagactaactctacgttttcccaggaacgtagttgtagttccgtgtccgaccggcccgtcgtacgaccgtacgggtttacgttttaacttaccgttggttacggacggtaagtaacgggtaccggttacttaagtttagttaggtttagtttttcggggtaagtttggttttaactttaccggaaccctacccgttaaggtacgttacggggaccggggtcctcccgggtacccgggtacggggaccgtaagggaaccgttacggtacggtccctacccgtaccgttccgttaccgtcccgtaccgaaaccccgtccggtaccctaacggttcccggttcccctccccggttacccggaccccttacccccgttccgtaacccggtaccggtaccgtaccccg

SEQ ID NO: 143048 - DNA, 723 bp, Homo sapiens
  misc_feature: GYAE6OF02F8QNF.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctcctgtctgcaaccggtgganacagtgtacacctatcacttggccgggacaaggtcggaactagttagaacctaccttaatttaaagttggtatacaacagtagaccgacgggaccgacccctaagcctacctaatctatgctagactactccgtagttcgacgtaaggtccggtacctagtcgtagtcgagtcggacgtaggtgtactcggtaggtaacgtagttacttacacgtacctaccgtactacgtctaacggtacttccgtaacggacttaagggtactaaacgtttcgtttaacgaacctttaaccggtttaatttaccgtacggtaaacccgtaagttaaacgttaactttaccgtaacggttttcggttaacccggaaccggtaacgggtaacctacgtaaaccttaaaacgttaaaaccggtttaaccggtaggttacgtacgggtaaccttcgacccgtaaactttggttcccttaaccgtttccgttacgtacccgtttaccccttaccggtaacctccggtttacgtacccttaagg

SEQ ID NO: 143049 - DNA, 663 bp, Homo sapiens
  misc_feature: GYAE6OF02G74S0.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcgaccatccacttcggcccgggcaaggtccggaacattgacctaaccttaatttaaacgttggtaactcaaactatacgaccgagggaccgacccctaagcctacctaatctagtgtactgcctatcctagtttcgactaaagggtcgggtaccagtcgtaggttcaggtggctaggtgagtcgtgggaacttaagttctactacgtaccactactacgtaacgtactcgtacgtacgtacgtagtacgttatttcgaacgttacttaagtcgttactaacgtactaagtactttaacgtaagtttcggttacggtaaccggtaaggttacgtaaccgtaaacttaacgtaaacgttaaaccgtacgtacggtacgtacgtaccgtactaaccgttcgtccgtttacggttaccttacctacgtttacccgttaccgtacctacgtttcgtacgttacgtacg

SEQ ID NO: 143050 - DNA, 596 bp, Homo sapiens
  misc_feature: GYAE6OF02GCQDC.46.67.G01.1.454.CMB.1.raw
  modified_base (221)..(221): a, c, t, g, unknown or other
  misc_feature (221)..(221): n is a, c, g, or t
  modified_base (417)..(417): a, c, t, g, unknown or other
  misc_feature (417)..(417): n is a, c, g, or t
  modified_base (583)..(583): a, c, t, g, unknown or other
  misc_feature (583)..(583): n is a, c, g, or t
tcagactagcagtacacgaccggtgctcgatttagagtatacatattggggtttgggggagtctcggtcaggacacagcatggacatgagggtcccgctcagctcctggggctcctgctactctggctccgaggtgccagatgtgacatcgagctgacccagtctccatcctcctgtctgcaaccggtgggagacagtgtcaccatcacttcggccggganaaggtcgaacattcgactacttatttaaatgtatacaacatacgaccgacgggaccgtccctaagccttacctaactctactcgctcgactacgttcctaggtttcgacgtaacgggtcggggtaccctagtcggtaggttacaggtggcgtaggtggtatcgtacgggactaggtacttctacttactaccaccnctactaagtactctagactagtagtaattatttcgtactaatttattactgtacaatactaattactacgtacgtttcggactaggacacgtaacttaactaaacttaaacgtaactagtacgtactcgaccgtatactcgttatcttacgtacttccgttacccntaacgttcatacg

SEQ ID NO: 143051 - DNA, 707 bp, Homo sapiens
  misc_feature: GYAE6OF02JZXUT.46.67.G01.1.454.CMB.1.raw
  modified_base (163)..(163): a, c, t, g, unknown or other
  misc_feature (163)..(163): n is a, c, g, or t
  modified_base (192)..(192): a, c, t, g, unknown or other
  misc_feature (192)..(192): n is a, c, g, or t
  modified_base (508)..(508): a, c, t, g, unknown or other
  misc_feature (508)..(508): n is a, c, g, or t
  modified_base (525)..(525): a, c, t, g, unknown or other
  misc_feature (525)..(525): n is a, c, g, or t
  modified_base (548)..(548): a, c, t, g, unknown or other
  misc_feature (548)..(548): n is a, c, g, or t
  modified_base (687)..(687): a, c, t, g, unknown or other
  misc_feature (687)..(687): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgcagatgtgacatcgagctcgacccagtcnccatccctcctgtctgccaaccgtggganactaggtctaccaccctatccgtaccgttcggacccgggtactaacggttacccgggaatagttccgaaccttaacccttaagttttaaaaccgttggttaactacctaaacgtagttaacgacccgtaaggggttaaccccggacccctaacggtaccttaccttaaaccgttacctaacgttacggacttcgaacctccgtacccgttaaggtttcacggtaaaccggttcggggaacccttaagtcgtaacggttaccaagttcgggactaggaggtactcgaggtacagttacttacctacgttaccgtacncaacttagacgtgtacncgtaactaccgtagtatacgttntaacgtactttacgtgttacgtactaacgtaatactagtagttacgtttaccgaacgtcgaagtaccgaacttactaaactacgtacgtagtcgtacgtctaccgtacgtactccgttgtactgtacctcccgtacctntaccttacgtacgttaaccg

SEQ ID NO: 143052 - DNA, 799 bp, Homo sapiens
  misc_feature: GYAE6OF02IR2CR.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagagtgggtcctgtccctggtgcaactgcaggagtccgggcccacggactggtgaggtccttcgggacgaccctcgtcccctcacctggcgctgtctcgtggtcgcctcatcgagttagttcggtttctcggtggggtcgtcggggtccggacacggccgtacccggaaggggtaacgggggcttagggaacttacgtagtttagggaagttggttcctcgtacaaggttaggttcgggtaacggtttccctaaagttaccgtacggttcccgttacctaccgttaacaaaggtcggttccggtaacgtacccaaactacgttattccgtcgtacgggaactaccggtcctaacgactaaacttccgttaccgtttttacccgaaggtaaacgtagtcgtagtttctacgggtactccccggccgtcgtacggtaacgtaccggggttaatttacgttactcggtagcggaagccggtaacgtagtactttagtacggttttagtttagggtacggttttacggttaacgtttacctaaccgtttacccgtaagggttacggtaccggggtaccgggtcccgtaaccgggtacccggtcggggtaaccgggtaacgaaccggtttcggtccggttaccccgtaccggtttacccgttaacgttacccgacccgttaacccgg

SEQ ID NO: 143053 - DNA, 659 bp, Homo sapiens
  misc_feature: GYAE6OF02HXIKX.46.67.G01.1.454.CMB.1.raw
  modified_base (326)..(326): a, c, t, g, unknown or other
  misc_feature (326)..(326): n is a, c, g, or t
  modified_base (425)..(425): a, c, t, g, unknown or other
  misc_feature (425)..(425): n is a, c, g, or t
  modified_base (446)..(446): a, c, t, g, unknown or other
  misc_feature (446)..(446): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatggtgacatcgagctggacccagtctccatcctccctgtctgccgaaccgtgggacacaggtcgtcacctatcattcggccgggctaagtcggaaactgttcgaacctaccgttaatttaagttggtacttacaaacagtacgacggacgggaccggtaccctaagcctactaagtctactgtacngactactccgtagttcgaaccggtaaagggtccgggccctagtaccggtagttacgaggtcgacgtgtaggatcggaggtaactagttactactaccgntaccgactatcgtaagttacncgtagaccgaacgtagaaacgttcttaggacttaactttacaagtttcgaaactagaaagttaacttaacgtacgtttcggttaacggacgaacggtactaaacgtaacctaaagtaaacggtaactacggtagaccgtagtcctaacgcttacgtacttaccggtttctacccgttagttcccgtacccggtactaaccttgaaccgttacg

SEQ ID NO: 143054 - DNA, 783 bp, Homo sapiens
  misc_feature: GYAE6OF02GP127.46.67.G01.1.454.CMB.1.raw
  modified_base (538)..(538): a, c, t, g, unknown or other
  misc_feature (538)..(538): n is a, c, g, or t
  modified_base (736)..(736): a, c, t, g, unknown or other
  misc_feature (736)..(736): n is a, c, g, or t
  modified_base (766)..(766): a, c, t, g, unknown or other
  misc_feature (766)..(766): n is a, c, g, or t
tcagactagcagtacacgaccggtgctcgatttagagtatacatattgggtttggggagtctcggtcaggacacagcatggacatgagggtccccgctcagctcctggggctcctgctactctggctccggagtgccagatgtgacatcgagctgacccagtctccatccctcctagtcctgcaaccggtgggacacgtagtgtaccacactcgtaaccgttcggaccgggtactaaacggtcggtaacgttaagttacggaacctaacccgtttaaagtttttaaaaccggttaggttaaccgtactaaaaccgttagttaaccgaaaccggtaacggggtaacccggtacccccgtaaggtacccttaaccgttaaacttcgtaacgtcgtactcgtactactccgttaggttacgtacgtaaacgttcgggtaacctacgtcggttaggtttacacggttcggaccgttaggtacggtaagtcggtacgggaaccgtaggtttaccttacctaccgttacgacctaaccggttanaacctagttttaacgcttaccgacgtaacggttaagacgttacttttacgactttaaacgttattacgttaacgaccttaaagttaacgtaacttaactttaacggttttcgtaacccggacgttaaaacgccgtaaacttaaccgtaaaagtttaaacgtaaacccgtaggtcgtacgttacacggtaccaacgttncggttaactacttccttacgtcctacccgntaacggttccaagttcc

SEQ ID NO: 143055 - DNA, 710 bp, Homo sapiens
  misc_feature: GYAE6OF02IKJF9.46.67.G01.1.454.CMB.1.raw
  modified_base (224)..(224): a, c, t, g, unknown or other
  misc_feature (224)..(224): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaaccggtgggagacagtcgtcaccatcacttggcccggganaacgtacggaacctattcgacctaaccttaattttaaagttggtaataccaaactaagtacgaaccgaggggacccggtacccccgtaagaccttaccctaaagttccttagtaggtcctgtaccacttccgtaagttttcgacgtaaagggttccgggtaccctaggttacggtaacggtttcgaggttggacctaggttgagttccggtagggtactagttactttaccacttaccgtaccactatacgtaattaactgtacgtacgtaaacgtagtaattactttacgtacttaactttattaccgtagtactaaacgtaattaacttactaacgtttacgttaccgaacggtaacgtaaccgaacgtaactaaacttaaaacgttaaacgtaacttcggtagtactacggtaccctaacgttacttcgttacgtttaccttacgtacctttaccgttacccgcctttactcgtaacttaccg

SEQ ID NO: 143056 - DNA, 644 bp, Homo sapiens
  misc_feature: GYAE6OF02I7UU9.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagttggtttcttcgtggggtcgtggggtccggcaggcctcccgaaggggtaaggggctaggaatacagttgggaagtgtctctcataggtaggaggttcctattacagtccgtcgtctcaagtagtcgagtcgaccatatctctggacacgtccagcaatctagttttcccagaagacgtagagttctagtcgaccggcgacgtgaccgacgggtacgtttaatacgttgtgcgaggtacgacggtactattatgttagttttggaggttgttattcgacacccgttagacgtcgggaccgggtctccgacccggtcggggaccgtagggaacttacgtggtcctaccggttccttccgttacgtccctaccgaccgaaacgggtcccaagttcccgggttaccctttcccccggtacggtccctaccccgtacccgtttacccgaacggtacgtaccccg

SEQ ID NO: 143057 - DNA, 715 bp, Homo sapiens
  misc_feature: GYAE6OF02IV7V3.46.67.G01.1.454.CMB.1.raw
  modified_base (200)..(200): a, c, t, g, unknown or other
  misc_feature (200)..(200): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctagacccagtctccactcctccctgtctgacaacggtggagacagtntcacatcacttcgccgggacaaggtacggaactagttacgacctaccttaatttaaagttagtataccaataatacgtaccgagggaccggacccctaagcctacctaatctatgtctgactactccgtagtttacgagtaaacggtcgggtaccagtacggtggttacaacgggtgacgtcggtaggtacgtcggtacggacgtaaggttactttacctaccgttccctacctaaaccgtctaacgtaagttaacctcgtaacgacctaacggtagtaaacgttgtttacgaaccttaaagtttaacttaccttacgtaactaactaaagttaacttaaataccgttttacgggttacccggaaacgtaaaccgggtacaaccgtaaaccttaaacgttaaaaattaacccggtaagttcgtaccggtctaacgtaccttaagtaccgttgttacccttacttaaccttaccgttaccccgtttaccgacttaacggtttcctaacggttaccg

SEQ ID NO: 143058 - DNA, 719 bp, Homo sapiens
  misc_feature: GYAE6OF02JHYCB.46.67.G01.1.454.CMB.1.raw
  modified_base (220)..(220): a, c, t, g, unknown or other
  misc_feature (220)..(220): n is a, c, g, or t
  modified_base (362)..(362): a, c, t, g, unknown or other
  misc_feature (362)..(362): n is a, c, g, or t
  modified_base (488)..(488): a, c, t, g, unknown or other
  misc_feature (488)..(488): n is a, c, g, or t
  modified_base (693)..(693): a, c, t, g, unknown or other
  misc_feature (693)..(693): n is a, c, g, or t
tcagactagcagtacacgaccggtgctcgatttagagtatacatattgggtttggggagtctcggtcaggacacagcatggacatgagggtccccgctcagctcctggggctcctgctactctggcctccggaggtgccaggatgtgacatcgagctgaccctgtcctccatcctccctgtactcgccgtaaccggtgggacgactacgtcgtccaaccntcctacgttcgggacccggggacaagggttcccgggaaactagtttagaccctaccgtttaatttaaacgtttggaacttccgaaactgtaacgaccgagggtacccgcccctaagccttaccgtaatccgttatcgtacgngtacctacgtcacggtttgacgtaacgggtcgggacctagtcggtaggttcgaggttcgacgacgttggtactcggtacgggactagtactttccgacgtctacctacgtatacgactcgtcgtanacgtaaggtctaaagttctttaccggaattaccctttagttaccgttctaaaccgtaagtaagttacttaacgttagtttacggttaaccgggaacccgtagggttaaccctaaggtaaccctaaattaaaacggtaaccgtacgtacggtaggaccttacggaaccgtacttacgtacgtcggttaaccccttgtacccttccncccgttaactgtaccttcgttaaccg

SEQ ID NO: 143059 - DNA, 713 bp, Homo sapiens
  misc_feature: GYAE6OF02G46BG.46.67.G01.1.454.CMB.1.raw
  modified_base (260)..(260): a, c, t, g, unknown or other
  misc_feature (260)..(260): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggagaccctgtcccctcacctgccgcttgtcctcgtggtcgcctccatcagtagttcggtttctcgtggggctcggggtccgnacgtccgtcccggaaggggtagggtctaggtaaactccgtaagttacgggaagttcggtcctcgtcctaagttacggtggtaacggtttccttaagttacgacggttcccgtactcgtacgaacgcgtcgtacggtccaactacgttactctccgtaggacctacgaccgagactaactcgtacgttttccagagtcgtacgngtttcgnggtccacccggtcgcgtacgacgtccggttatttacgtctggtcgagacgacggtctcttaagttcgttaaggtttgtttagtacggtttacgtttacgttccgaactaccgttagtcgggtaccggaccggggttacccgtacccggtacccgggttacgggtaccgaacgggttaaccttacgggttacccggtaccgttacccggttccctaccgttaccggtcccgttaaacccccggg

SEQ ID NO: 143060 - DNA, 661 bp, Homo sapiens
  misc_feature: GYAE6OF02JUEK5.46.67.G01.1.454.CMB.1.raw
  modified_base (150)..(150): a, c, t, g, unknown or other
  misc_feature (150)..(150): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (556)..(556): a, c, t, g, unknown or other
  misc_feature (556)..(556): n is a, c, g, or t
  modified_base (583)..(583): a, c, t, g, unknown or other
  misc_feature (583)..(583): n is a, c, g, or t
tcagactagcagtacacgaccggtgctcgatttagagtatacatattgggtttgggagtctcggtcaggacacagcatggacatgagggtccccgctcagctcctggggctcctgctactctggctccgagtgccagatgtgacatcganctgaccctagtctccatcctccctgtctagccaacgtggganacngtgtaccacatnacttgccgggacagtccggaactnttgaacctcttaatttaaatggtatacgaacataacgacctaaggaccggaccccgtaatccgtacctaatcgtaatcgtctcgcctaactcccgtagttttacgacgtaaacgggttccgggacccttagttccggacgtttacgacggtgaccgtaggtagtacgtctaggggaccaggtacttcctactcgtaccacgtactacctagtacttactccgtaacgaaccgtttagaagttaccttttagtaccttaactttaagttaccgttagtacaacgttaacgtaaacttacgtatttacgttacggtacgtaacgtanacgtaattaaccgtaaattaaaccggngttacgtacgacgtcgtactactactcgttacttactacttacttccccgttaccgtactaccgtattacgttaaccg

SEQ ID NO: 143061 - DNA, 770 bp, Homo sapiens
  misc_feature: GYAE6OF02F86VN.46.67.G01.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgcaaccgtgganacagtntcaccatcacttggccggganaagtcgaactattgacctactaatttaagttgtatacaacatagaccgagggaccgcccctaagctacctaatctatgctgctatccagtttgacgtaaacggtcggggtaccctagtacggtaggttacgaaggtcgggacgtaagggtcggtacgttacggtacgggggaaactaggttaactttaccaaccttcccgtaccaaccctacgtacgtaacgttaatccgtacggaacgtaaacggttaggtaaacgtttagttttacggtaacttaaaccggttttacttaaccgttacgttaaactaaactaaacggttaaactttaaaccgtaaatttacgggttttaacccgggaaccggtaaacgggtaccgtaaccgttaaaccgttaaaaccgtaaaaacgtttaaaaccggtaacgtttacggggttacggtaccgttacggaacccttaaaccgtaaccgttaccgtttacgttaaccctttacgtaacccttttccccgttaacccggtacctaaccgtttccggtaacgttaaacccg

SEQ ID NO: 143062 - DNA, 925 bp, Homo sapiens
  misc_feature: GYAE6OF02GGKRD.46.67.G01.1.454.CMB.1.raw
tcagactagcagtacacgaccggtgctcgatttagagtatacatattgggtttgtcctcctgctggtggcagctccagatgggtcctgtccctggtgcaactgcaggtacgtccggcccaggactgggtcgacgggtccttcgggacgtaccctgtccctcaccgtgccgtctgtcctcgtacggtcgtacctcctagtctagttacggttcgtttcttcggtcggggacttcggggtccgacttagcccgtaccggagggggacggtactcggtaaaactacgtgttacggggaacgttctccgtacgtaacgtaggttcggtacggtacggttaccttaattaccgtacggttaccccgttcgttaccgtacgtaaacggtccggtacgtaacggtcctaaacgtacgttacttccggtaccggtacgggtaaacccaacgggttccctaaaggtacctaaacgtttccggtaaccggttttaccgaaggtaaccgttaacggtggttaacgtttccgtaggtaccgtaccggttacccgtcggtttaacgaaccgggttccgggttaacttttaaccggtttacgacgttacggacgttaggaaccggttacgtaccgtttaattaacgttcggttttaaagtcgggtttaagttaccgttaacggtttacccgtacggtaacccttaaggtaccgttccggggaaccggtccgttacccgggtaccggttcgggaaccggttaacggtacggttaaccgtttacgggttcccgtaaccggtttaccgtcccgttttaaccggaccgtttacccgtaaccgggtaacccggggttacccttaccggttaccccggttacctttcccggggtaaccacccctttacccggttaccaacggtaacccgcccggtttaaacccgg

SEQ ID NO: 143063 - DNA, 769 bp, Homo sapiens
  misc_feature: GYAE6OF02F13OI.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtcgggcccacgactggtgaggccttcggagacccctgtcccctcacctgcgctgtctcgtggtcgcctcatcagtagtggtttctcgtggggctcgggtccgcagccgtcccgaggggaacgggctaggaatacgtagttggagtgtcctctacagttagtcgggtacgttacctagttaacgtcggtcccgtctctcgaagtcgtcgagtccaacatatcgtgtagggactacgtccagtaccagttccttagtttcccaagaacgtagtacgttacgtttcgtacgtacggtcccggccgtcgtacgggtaaccgtacggggtttaccgttttaagtttaccggttggttaacgtaccggtaagggtaaccgggttaaccgggtatttttaacggttagtttacggtttaggttttttacgggtaggttttaggtttaacgttttcccgaacccttaacccggtttaaggaccgggttacccggggtaccggggttaccgtcccgggtaacccccggggtaggggtaacccgtaacggggttacgtttaccgggttccgggtaacccctttaccggttacccgtttaccccggtttacggacccccgttaaccccggg

SEQ ID NO: 143064 - DNA, 759 bp, Homo sapiens
  misc_feature: GYAE6OF02JBUC5.46.67.G01.1.454.CMB.1.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (473)..(473): a, c, t, g, unknown or other
  misc_feature (473)..(473): n is a, c, g, or t
tcagactagcagtacacgaccggtgctcgatttagagtatacatattggggtttgggggacctcctgtgcaagaacatgaagcacctgtggtttgtcctcctgctggtggcagcctcccagatcgggtcctgtccctggtgcaactgcaggacgtccgggcccacggacttgggtgaggtccttcggacgacccctgtcccctcaccgtgcgctgtcttccgtggtccnccctaccatcgacgtgttgtttcctcggtggggccgttacggggtccgcnggtcccgtaccgagggggtacgggtctggattaccgtaggttacggaacgttcgtaccgttcctacgtaagtttacggggtcgggttaaacggtttcccccttaaagtttacccggagggttttccccgtacttccccgttacgaaaaggttcggtaacgactcctaaccgtattacctcgtacgtaggtaacnccgtacccagacctattaccgtacgttttcccgaagtaaggtcgttatcgtttcgacgaccggaccctcggtacgttaggacccggtacgggtttacttttaagccgtggtaacggcgtagaccggtcgttagttaacttggttatttacggtttgggattcgggttttaaccacgtacctacgttagccgttacgggttccggccttacccgggaccgggttcgaacggtacgtaacgttacggcggttaccctcggtcccgttaaccgtacgcccctaacccgg

SEQ ID NO: 143065 - DNA, 836 bp, Homo sapiens
  misc_feature: GYAE6OF02I1E9T.46.67.G01.1.454.CMB.1.raw
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccactccctcctgtctgaccgaaccggtggganacgngttcgtaccacctatcctacttcggaccgggacaaggtcggaactagttcgaacctaccttaagttttaaacgttcggtacttaccgaaactacgttaaccggaaccgacggggaccgtaccccctaaggacccttaccgtaaatcttaagtcgtcgtacgacctacttccgttaaggttttacgaacgtaaacggggttccggggtccctaaggttaccggtacggttacgtaacggtcggggtactagggtcggtaacgttccggtaggggactaggttactttacgaccgtcgtaaccgtacctaacgtaccgttaagtacttaccgtcggaaaccgttaaggttacggttaaacgtttctttacggtaaccgttaaccttttagtttaaccgttcgtaaacgaaacgtttaaccgtaaacgttttaaccggtaagtttaccgggggtttacgaaacccgggttaacgggaaccgttaaaccggttaaaccgtttaaaaccgttaaaacccgtttaaaccggttaaccgttagggtccggtaacgttacgtaacccgaacctttacgttaccgttaaccgttcctttaacaccgtttccccgtaccgtacctaacgttcgtacttaaccgg

SEQ ID NO: 143066 - DNA, 873 bp, Homo sapiens
  misc_feature: GYAE6OF02HQ9B1.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtcccctcacctgcgcttgtctctggtncctccatcagtagtggtttctcgtggggctgggtccgcagcctaccgagggaacgggctggaattccagttggaatcgtacctctcaagttacggtggtaacggtttccctaagtttaaccgaggtttccccggtcttcctaccgtaaagggtacggttaccggtaacgttacccaacccgtaacttaaactttccgtacgttacggggtaaccctaaccccggttacccaaggtaacccttaaacgttacccgttaaccggttttttacccccaaggtaaacgtaacgttacggtaacgttttcgtccgggttaacggacccgtcccggtacggtaccggaaccggtacgggggttcctttttaaagttccgttaggtaccggtacggaaagggtaccgggaaccggttacgttaagttaacgttggtttaacgtttttacgggtaagtttcgggtttttaacgttccggtaaccctacccgtaacggttaccgtacgggggtacccgggtacccgttacccgggttacccggacggggtaccgaacgggttaaccggtacgttccgggtaacctacccggtccttaccgtttaccgcccgttaaccgacccggtaaccggtaccccgtattccccgggttacccttccccggtaccgaccccttcccttaccgtaaccccgaagtcccgtaacccgg

SEQ ID NO: 143067 - DNA, 551 bp, Homo sapiens
  misc_feature: GYAE6OF02ICPJ6.46.67.G01.1.454.CMB.1.raw
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
  modified_base (389)..(389): a, c, t, g, unknown or other
  misc_feature (389)..(389): n is a, c, g, or t
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
tcagactagcagtacacgaccggtgctcgatttagagtatacatattgggtttggggagtctcggtcaggacacagcatggacatgagggtccccgctcagctcctgggggctcctgctactctggctcgaggtgccagatgtgacatcgagctgacccagtctccatccctccctgtctagcaaccggtgggagacagtgtcaccatcacttgccgggnaaggtcggaacagttcgaacacttatttaaaatgtatctaacatanacgaggacggcccctaagctcctaagtcctatgctgcatcctntttagcaaagtttcgggacctataccgaggttcaggtgcagtgatcgnggacagattcactctcaccgatctaagtactntacgactagaaggtagttattacgaactaattagtcgtactaacaacgtaacttaattacgtaacgtttgttaaccgacgtaacggactaaggtacaaataaacgtaaacagtacgngtatcgatactagtntcttntatctaccgctacgcttcgataacc

SEQ ID NO: 143068 - DNA, 643 bp, Homo sapiens
  misc_feature: GYAE6OF02F6URM.46.67.G01.1.454.CMB.1.raw
  modified_base (290)..(290): a, c, t, g, unknown or other
  misc_feature (290)..(290): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctccgagggaagggctggaatacagttggaagtgtctctcatagtggaggttcctattacagtccgtctctcaagngtcgagtcaccatatcctcgtggaccacgtccagcaattctacgttttcccagtaagtagtgtagttctggtcgaccgcgctgaccgtacgggtcttttaattactgtcgacggagacgacggtcttattatgttagttttggagttggtttacttcgaactacccgttagacgtaccgggacggggtcctaccggtaccccggtaggggacccgtaagggtaacgtacgttcgggtacccgtaccgttccgttacccgttacgtccctaccgtaaccgaaccgggtaccctacggttcccggtcccgtttcccccgtggtcccctacccttcccgtacccgagaccgtcccg

SEQ ID NO: 143069 - DNA, 1112 bp, Homo sapiens
  misc_feature: GYAE6OF02G1B6A.46.67.G01.1.454.CMB.1.raw
  modified_base (274)..(274): a, c, t, g, unknown or other
  misc_feature (274)..(274): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggacccacgactggtgaggccttcggagtaccctggtcccctcaccttggccgcttgtcctcgtggtcgccctcatcctaaggttcggttggtttcttcggtggggtcgttcgggtcccgnacgtccgtacccggagggggaacgggtctaggaactacgtagtaggaagtcgtctctacgataggtggtacggttcctattaccgtacggtccgtctcgtacgaaggtacgttcgacgtccaacgtaattcgtctacgtacggaccaacgtaccgacgtactaacgttacctaccgttttcccgaaggtaacgttacgttacggttacggttccgttacggtacccgggtaaccccgtcccgtaccggttacgggaaccccgggtttaccggggtttaccctttttaaacgttaccgggttaccgggttacgggtaacccggggtaaacgggtaaccgggttaaaccccggggttacgtttttaaaacgggttttttaacgggtttaccgggtttttttttaaaggggtttttttaacgggggtttaaagggggtttttttaacccgggggtttttttaaaacctttttaacccccgggggttaaaaaccccccgttttttaaaaccccgggttttaaacgggggggtttaaaacccccggggttttaaccccggggggggggtttaacccccggggggtttaccccccggggttttaaacccccccgggggtttaaccccccccccggggggggggtttaacgggggggtttaaaaccccccggggggttaaaaacggggggttttaaaccccggttttttaaacccccggggggttaaccccggggtttttaaccccccggggtttaaccccccgggtttttaaaccccggttttaaccccccgggttttttaacccccccgttaccccccggggggtttaaaaccccccccccgg

SEQ ID NO: 143070 - DNA, 678 bp, Homo sapiens
  misc_feature: GYAE6OF02HQYUR.46.67.G01.1.454.CMB.1.raw
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctgacccagtctccactccctccctgtctgacgaaccggtgggagacaggtctccacctactctaccgttcgggcccgggtacaaggtacggaactattagaacctaacttatttaaagttgtatacaactagtaacgaccgacgggaccggtacccctaagtcctacctaatctatcgctgcagtctagttcgacgtaggtccggtcagtcgtaggttcaggtgcagggtgattcggagactagtatttcactcgcacatcatancgtagactaagngtaacgttgtttacacgttaactttagtacgttacgtaactaaacgttaagtaaactttcgtaaagtttcgggtttaaaccgaaccggtaaacgggtaacctaacggtaaaaccttaaacggtaaaaacgttaaaccgaacgtttggggaaccctgtaccgtaacctaacgttacttaacggttccgtttaccttaccgtaacccgttcccgtaccccgtaacggtttacttaccggtattaaccg

SEQ ID NO: 143071 - DNA, 833 bp, Homo sapiens
  misc_feature: GYAE6OF02H02V4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctcgaccagtctccatccctcctgtctgcaaccggtgggagacgagtgtcaccatctacgttcggccggacgaaggtcggaactattacgacctaaccttaattttaaattacggttactaccaactaagtaacggaccgacggggaccgtacccctaagccttaccttaacttacgtatcggacttggacctacgtccgtagtttacgaacgtaaagggtccgggtaccctagttacgtacgggttacgtaggtcggtacgtagggtacgtaacgttcggtacggggtaactaaggttacgtttaccgtaaccttacgtaacctacctaacgtacctaaagttaacgtccgtacgtaaccggtaacgttaacggttaagttacgttttaaccgaactttaaaccgtttaacgtttaaccgtttacgtaaaccttaaaacgtaaacgtttaaacgtttaacgtttaacgttttaccgggttttaacccggtaaccggttaaacgggtaacccgtaaaccggttaaacccgttaaaacgttaaaaacctttaaaacggtaaacgtttaccggtacggtaccgttactacccgtaaaccgttaacggtttaccgttacgttaacccgtttacttacccgttacccggtttaccccgttacctttaattaccggttagttaaccg

SEQ ID NO: 143072 - DNA, 657 bp, Homo sapiens
  misc_feature: GYAE6OF02HMZMJ.46.67.G01.1.454.CMB.1.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttgggggagtctcggtcaggacacagcatggacatgagggtccccgctcagctccgtggggctcctgctactctggctcgaggtgccagatgtgacatcgagctgacccagtctccatccctcctgtctagcaacgtggganacagtcgacacctatctacgtcggccgganaacggtcggaactgttcgaacctacttaagtttaagttggtataccaactagtacgaccggagggacccgtaccctaagccttacctaatctagtcgtactgacctagttccgtagtttacgacgtaaggtccggtacctagtcggtaggtctaggtcgacgtaggtacgactcggtaggaacgttagttacgtttcaaccttccgtaacaccgtagtacgttaagtaactcggtacgacgttaacggtataggttacttacgacttaacgtttataccgtctaanaacgtaattaattactagtttaccggttacgaacgtagaacctacgtaacgttaacttaaacgtacgtaacgtggtacaccgtagacctaacttctaccgttacgttaccttaactaccttcccgtaccgttacactttacgattacg

SEQ ID NO: 143073 - DNA, 898 bp, Homo sapiens
  misc_feature: GYAE6OF02GZMWM.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagagtcgggtcctgtcccgtggtgcaactgcaggagtccgggcccacgacgtgggtaggacggtccgttacggacgtaccccgttcggtaccccctaccacccgttcggccgtccgttcggttccctttcggttgggtacccgtcccccttacccgtaagttccgtaagggttttacggtttcggttttttcccgttccggggtcgggggggttccgttccgggggtcccgggtaccgtacgggtacccccggttacccggggaacggggggtaacgggggtaccgtaacggggtaaacctaacgttacgggttaagggtaagttcgtccttacgttacgtaaggttacgggtaggtaccggttaccttacgttacgtaccgttccgttctacgtacgaagtcgtacgtacgtctaactacttaacgtcgtacgtacgaaccttacggacctacgacgttaacgttcccgtttacgttttccgaaggtaacgtagtttacggttacttacggtccgtaccggtaccgtccgtacgtacggtacgtaccgggtttacttacggttcgtaggtcggtaagtacggtacgtacgtttacgtatttggttaggtttaggttttacgggaagttttaccggtttacgttaccgtaccctacgttaaccgggtcgggtaccgggaccgggtccctcccggggtcccgggtaaggtacccgggtaaggtaccgttacggtccgtacccgttaccgtccggtttccctacccggtacccgtaacccgg

SEQ ID NO: 143074 - DNA, 584 bp, Homo sapiens
  misc_feature: GYAE6OF02GFNQY.46.67.G01.1.454.CMB.1.raw
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggagacagtgtcaccatcacttggccgggcaagtcgaacatgactacctatttaatggtatcaacatagaccgagggaccgcccctaagctacctaatctatgctgcactcctagtttgacgtaaaggtcgggtaccagtcggaggttcaggtggctaggtggatcgagggacagtcttcactctacactatcagtatcngtacaagtagtaagttatttgactaacttattacttatactaatataattactagttggtttacgacgtaagggtacaacgtaactaaactaaacgttaaacgtaacgtagtacgacgttacgacgtaacctagttaccgttagttacctttacgtaccttacccgttacccgaccttaacgttccgtagttaaccg

SEQ ID NO: 143075 - DNA, 648 bp, Homo sapiens
  misc_feature: GYAE6OF02F6XZ7.46.67.G01.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (633)..(633): a, c, t, g, unknown or other
  misc_feature (633)..(633): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacntcacttcgccgganagtcgacattcgacacctatttaatgtatcaactatagaccgagggaccgcccctaagctacctaatctatgcgtcgctactccgtagtttgacgtaaggtcgggtacccagtccggtagttcgacggttggactacgggtacggtattccgtaggggaactaggttaactttcgaaccgttctacctaccctattccgtaagtttacttcgtacgaccgtaacgttagtaaacgtttagtttaccgaacttaactttacgttacgtacgttactaaacgtaagtaactttaacgtaatttcggttacggaacccgtagggaactaccgtaacttaaactaaagtaacgtaacgtgtacgtactacggtacctactacgttcttaacgttcctacgttccttaccgttccccgtanaccttactcgttaac

SEQ ID NO: 143076 - DNA, 834 bp, Homo sapiens
  misc_feature: GYAE6OF02ILBS1.46.67.G01.1.454.CMB.1.raw
  modified_base (189)..(189): a, c, t, g, unknown or other
  misc_feature (189)..(189): n is a, c, g, or t
tcagactagcagtacacgaccggtgctcgatttagagtatacatattggggtttggggagtctcggtcaggacacagcatggacatgagggtccccgctcagctcctggggctcctgctactctggctcgaggtgccagatgtgacatcgagctgaccagtctcatcctcctgtctgcaaccgtggganacgtagtgtacaccgtatcacgttcggccgggataaagtcggaaactagttacgacctaacttaagtttaaagttcggtaataccaataactaagaccgtaagggaccgtacccctaagtaccctacttaactcctagtcgtactacgtacactaccgtagtttcggagtaaacggtcgggtacctacgttacggtacggttacgacggttaggacgtaacgggttagtacgttcggtacgggtaacgtaacggttactttaccgacgttacctaaccgtaacccgtaagtaccgtaaacgtttacttaccggtaacggtaacccgtaaaggtaacggttaaagggtttaaacctttacggtaaccgtttaaactttaacttaaccggttaacggttaaacaaacccgttaaaggttaaacctttaaacgttaaggttttaacggtttaaccgggtaaacgtaaaccggggaccttaaaaccgtaaccgtttaaaacgtaaaacgttttaaaccggaaacgttacgggtacggtacccgtaagttacccgtaaacggttaaccttaccgtttaacgttcccgtttaacgtttacccgtttacccgtacccggttactaacgttttacccggagtttaaaccccgg

SEQ ID NO: 143077 - DNA, 723 bp, Homo sapiens
  misc_feature: GYAE6OF02JV3QU.46.67.G01.1.454.CMB.1.raw
  modified_base (155)..(155): a, c, t, g, unknown or other
  misc_feature (155)..(155): n is a, c, g, or t
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (364)..(364): a, c, t, g, unknown or other
  misc_feature (364)..(364): n is a, c, g, or t
tcagactagcagtacacgaccggtgctcgatttagagtatacatagttgggttgtcctcctgctggtggcagctcccagatgggtcctgtccctggtgcaactgcaggagtccgggcccacgactggtgacggccttcggagaccctggtccctnacctgcgctgtctntggtcgcctccatcagttagtggtttctcgtgggcttgggtcccgnagcctacccgaggggaagggtctagggaattacaagttgggaacgtgtcctacgtactagttaggtggtaggttcctaattccaggtcccgtctttcagaagagtccgagtaccaccatactccttagcggtacaccggtacctacggntaaacttcctacggttttaccccaggtaataagttacggtcgttaccgttaggttcggaacccggtccgtacgttacggaacgtaacgggtttcgtttactttaaccggtggtacgacggtaggacgaacggtcgttaagttgttaggttagttttaggtagttcggtttattacgtaccgttacctagtacgtacggtaccgggtccgtaaccggtcccggtacgggtcggacggtacgtacgtcggtactaccgtcgttaacctaccgtctaaccgtaccgtaaccgggtcctacggtacccgttcccgttaccccgtcggtacccaccccgtttaccgaccgttaccgcgtacccg

SEQ ID NO: 143078 - DNA, 744 bp, Homo sapiens
  misc_feature: GYAE6OF02F0IQK.46.67.G01.1.454.CMB.1.raw
  modified_base (191)..(191): a, c, t, g, unknown or other
  misc_feature (191)..(191): n is a, c, g, or t
  modified_base (405)..(405): a, c, t, g, unknown or other
  misc_feature (405)..(405): n is a, c, g, or t
tcagactagcagtacacgaccggtgctcgatttagagtatacatatgggtttggggagtctcggtcaggacacagcatggacatgagggtccccgctcagctcctggggctcctgctactctggctccggaggtgccagatgtgacatcgagctgacccagtcctccatccctcctgtctgacctaccggnggagacaggtgtccacgatctacgtcggccgggactaggtaccgaactattcgaacgtacctttaattaacgttggtatacaacgatacggaccgaagggaccgtaccccgtaagtcctactaacgttcagttcgtcctaggtacgacgttacccgtaggttttcgaccgtaaacgggttccgggtacccctaacggttcggtacgggttaccnggtacgggacttaggggacgttacggtcgggtacgtaacggtacgtttaccttacgaccgttcccgtacgtaccgttacggttacctacggtttaactccggtacggaacttaacggtacgttaacgggttaaaccttttgggaaccctttacgtttacttacgtaaccgttaacacgtacgttacgtacgttaactacggtttccgtacggtacgtaagggaacctttcgaaaccgttagtaaacttccggtagttacgcggtactacggtcctacgttactaccgtttcgttaccgttacgtacccgttccgtaacccgtcgttaccgtcgtaaccg

SEQ ID NO: 143079 - DNA, 688 bp, Homo sapiens
  misc_feature: GYAE6OF02HABZN.46.67.G01.1.454.CMB.1.raw
  modified_base (149)..(149): a, c, t, g, unknown or other
  misc_feature (149)..(149): n is a, c, g, or t
  modified_base (522)..(522): a, c, t, g, unknown or other
  misc_feature (522)..(522): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggngtcgggcccagactggtgaggcctttcggagtacccctgtcccctcaccttgaccggtctggtcctcgtggtcccgttccattcaggtagttggttttctacgtgggggctggggtccggatagcctccgagggacggggctggaactctagttcggaagtgtacctcgtcataggtcggacgttcctaattacgacgttaccggtctctcaagtacgtcgacgtcaaccgtattacgtctcgttcgggacctaaccgttccgacgtcctaaactccgttaacgtttttccccaaggtacgtagtcggttacgtttcgtcggtcgaacccgtcggtcctggaccgtacgggtctttaacggttacctggtcgngacggtcgacggtcttagttactacgttagttttggatttcgggttaatttccggaacttacccgaagtacgttacgggacggggttctaccgggtacccggtgggtaccgtaaggtctaccggtcggtaccgtaacccggtgtacccgttacgtccgttaacccg

SEQ ID NO: 143080 - DNA, 733 bp, Homo sapiens
  misc_feature: GYAE6OF02GMGTV.46.67.G01.1.454.CMB.1.raw
  modified_base (206)..(206): a, c, t, g, unknown or other
  misc_feature (206)..(206): n is a, c, g, or t
tcagactagcagtacacgaccggtgctcgatttagagtatacatattgggtttgtcctcctgctggtggcagctcccagatgggtcctgtccctggtgcaactgcaggagtcggcccagactggtgaggccttcggagaccctgtccctcacctgcgctgtctctggtgcctccatcagtagtggttcttcgtgggctgggtccgnagcctcccgaggggaacgggctggaaatacagttaggaagttgtcctcgtcaagtgtggtaggttcctattacagtccgtctctacaagagtcgagtcaccagtatctcgtggactacgtccagcaactctagttttcccagaacgattgtagttacgtgtacgaccgtccgcgtacgacgtacgggttcttttattacgtggtacgacggtaggtacgacgggtccttaagtttacgttagttaagtttttacgggagttttaggtttaacgtttaccggtaaccgttaacccgttaggtaacgtaccggggtaccggggtccttacccggacccggttcggggtacccgtaagggtaaccgttacgttacggtaccgtaccggttcccgttacccgttaccggtaccctaccccgtaaccggaaacccggtacccgtaccgtttacccggttccccgtttacccccggtaccggttccccgtacccccttaaccccgtttaccccaaaggcccgttaacccccgg

SEQ ID NO: 143081 - DNA, 788 bp, Homo sapiens
  misc_feature: GYAE6OF02J0U5U.46.67.G01.1.454.CMB.1.raw
  modified_base (233)..(233): a, c, t, g, unknown or other
  misc_feature (233)..(233): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgacaactgcaggagtccgggcccacgactggtgacggtcccgttggacgaccccgttgtcccctacaccgtgccggtcttcgtcttcgtgggtccncccttccgatcgtacggttagttcggttttctacgggtggggccttacggggtccggactacggccgttacccggaaggggacgggtctagggaactacgtagttaggagttcggtctcgtctaagtaggtaggtacgttctagtaccagtccgtacttcacgtaggtacgtcgactacaccgtatacgtacgttcgtacggaactaccgtaccgtacgtacgtaacttccgttaacttttacccgtagaacgtagttacgtacgtttntcggtcgacccgtcgacgttacggtaaccgtacgggtttaccgtttacgttacgtcggttacggttaacggacggtaaccggtacggttaccttaacggtttagtttagtttaaccggttttaggttacgggttttacgtttaccgtttaaccgtaaccgtaaccgttacggacggtaccggggtacgggtaccttcccgggtaaccgttacggggtacgtaaggttaacttacggtcgttaacccggtccgttccgtttacccgtaccggtacccttaacccggg

SEQ ID NO: 143082 - DNA, 823 bp, Homo sapiens
  misc_feature: GYAE6OF02G6KM0.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgtcaaccggtggganacgagtgtcaccatcacgttcggccgggacaaggtcggaactagttgaacctaccgttaattttaaagttcggtaacttaccaaacgaagttaacggaacccgtaacgggggaacccggtacccccgtaaaaggtcccttaaccgtttaaaccgttacgttaaacgttcggaccgtttacggacctaacttaacccggttaaggttttacggaacccgtaaaaacgggtttccgggggttccccaaacgtttccgggtaacgggttttacgaagggtcggtacgtagggtacggtacgttcggtaacgggtacgtaacgttaccgttttaccgacttccgttaacacccgtatacgtacgtaacttcgtaacgtacgtaacgtaagttaacgttacgttttacgaacgtttaacttaacgttaccgttaacgtaactaaccgttaaaacgtaactttaaactaacgttttcggttttaaccggaccgggtaaaggtaacccgtaaacgttaaaccgtaaaaccgttaaagttaaaaccgtagttaccgtagtaccgtagtaccgtaacgtacgttacgtcgttaccttagtacccggttccttaccccgacttacgttcctagttaacg

SEQ ID NO: 143083 - DNA, 798 bp, Homo sapiens
  misc_feature: GYAE6OF02JVFEE.46.67.G01.1.454.CMB.1.raw
tcagactagcagtacacgaccggtgctcgatttagagtatacatattgggtttgtcctcctgctggtggcagctcccagactgggtcctgtccctggtgcaactgcaggagtcgggcccacgactggtgaggcccttcgggagacccctggtccctcaccgttcgcgtcctgtcctcgtcgggtcgccctccgaatccaggttagttcgggtttccttcgtggggtccttggggttacccggcgtacggccttccccgaaggggtaacggggtccttagggaactacgagtttcgggaacgtggttcctcgtctagtaggtcggacggtttaccctagttaccaggttccgttacctctacgaagtcggttacgagttccaaccgtatacgtcctcgtaggtacctaccggtccaagtaccgaatttaccgtaccgttttacccgaggtaaatagtccggtaatttcgtagtccgtaccgtcccgagtttacgaccgtcgggttaacttttaacgtccggtaggtccgtaacggacgtacggtacgttaccgttaaagtttcggtacgtttagtttacggttaggttaacgtttacggttaacttaccgtacgtacgtgttaccgggacggtccgtaacgtcccggtagggaccgtaaggtacctaacgtcggccgtaaaccgtccgtaaccgttacgacccgttaccggtaacgtcccgggttaccacggttcccggttacccgtcccggttacccgcccgttaacccctccggtaccgtacgtaccggtaccccgg

SEQ ID NO: 143084 - DNA, 876 bp, Homo sapiens
  misc_feature: GYAE6OF02GH9W4.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggagtcggccacgactggtgaggccttcggacgaccctgtccctcacctgcgctcgtctcgtggtcgcctcatcgagtacgttggtttcttcggtcgggcgttcgggtccgctacggccgtccgaaggggagggctagggaactaacgtaagtttaggtaagtcgttccgtccgtactaagtagggttcgggtacggtttaccttaacgtttaacgtaccggttcccgtttaccttaccgtaaccgtaaaggtccgttacgggtaccgtacctaaccgtaacgttaccttcgttaccgtacgggtaaccctaccgtaccgtaacgaccgtaaacgttccgtttaacgttttacccgtaggtaaacgtagttacgttacgtttccgttacggtaccggtacccggtcccgtacggtacggtaacccgggtaccggggtttaccgttttaacggttaccggttaggtacggtaacgggtacggaaacgggttaaccgtctttaaacgttacgttaggttttacgtttttaggggtaggttttaacggttttaacgtttaccgtaaaccgttaacccggttaagtaccgggtttaccggggtaacccggggttcccggtaaccccgggttacgggggtaaccggttaaccgggttaacgttaccggttacggttacccttaccggttacccgttaacccgttcccggttacccgaacccccggttaaacccggg

SEQ ID NO: 143085 - DNA, 848 bp, Homo sapiens
  misc_feature: GYAE6OF02GY4UN.46.67.G01.1.454.CMB.1.raw
  modified_base (774)..(774): a, c, t, g, unknown or other
  misc_feature (774)..(774): n is a, c, g, or t
  modified_base (781)..(781): a, c, t, g, unknown or other
  misc_feature (781)..(781): n is a, c, g, or t
  modified_base (802)..(802): a, c, t, g, unknown or other
  misc_feature (802)..(802): n is a, c, g, or t
tcagactagcagtacacgaccggtgctcgatttagagtatacatattgggtttggggagtctcggtcaggacacagcatggacatgagggtccccgctcagctcctggggctcctgctactctgctccgagtgccagatgtgactatcgagtctcgacccagttcctacctacttcccgtccctgtctcgaccgaaccggtgggactacgtggtcgtaccacctagtccgtacgttcggcccgggactaacggttaccggaaacttgttaccgtaaccttaaccgtttaatttaaacgttcggtaacctaccgaaacgtacgttaccggaaccggtaacggggtaaccccgtaccccttaaagtcccgttaacccgttaacttcgttaagtccggtaccttacgaacctaaccgtttacccggttaggtttacgggaaaccggttaaccgggggttacccgggtacctaaggtttaccggggtactttacggggaggttccggaggttagggttcggtacgtacggtacgggtaaacttcggttacctttaccgacccgttactaaccgtacctaacggttacggtaaactttcggacccgttaggaaccgttaaggtacgtttaaagtttactttaaccggaacctttaaagttttcccgtaaaggttacccgaaaacttaacggtttaaagtcgtttaaccggtttacgttcgggttaaccgaaacgggtcaaaactttaccgtaaattaacctaaagggtactgttaccgngttaccnggtacccgtattccgggtttntacccgtcttaaccctctaccccgttaacccttggtactactacgg

SEQ ID NO: 143086 - DNA, 751 bp, Homo sapiens
  misc_feature: GYAE6OF02GYVD5.46.67.G01.1.454.CMB.1.raw
  modified_base (400)..(400): a, c, t, g, unknown or other
  misc_feature (400)..(400): n is a, c, g, or t
tcagactagcagtacacgaccggtgctcgatttagagtatacatattgggtttggggagtctcggtcaggacacagcatggacatgagggtccccgctcagctcctggggttcctgctactctggctccgaggtgccagatgtgacatcgagctgacccagtctccatcctccctgtctcgcgaaccgtgggacacagtgtcaccatcacttgcccggagacgtaacggtaccggaacttgtacgacctaactttaaagtttaacgttagtaactacaaactacgtaacgaaccggtaacgggaccccgtaccgtaacgtcctacttaactctagtcgtcgtcgactactaccgttagttcgaacgtaacgggttccggtacctggtcggtacgttacgnggtcgacgtaggtgtacgtcggtacgggtactaagttcttacctaccttctaccacctatacgtaactacgtcgcgtaacgtagtaaggttaatttacgtttacgaactttacgttactttacgtacgtaactaaagttaactttaacttaacgtttacgtttacgtttaaccgggaaccggtaaacgggtcccaaacgttaaccgttaaaaccttaaaacggttaaaccgtagttccgtacgtaccgtacgtacccgtaacctttaccgttcgttaccgtttaaccttaccggttacccctttaccccgggttacccgtaccctttagtttacccgtaagtttaacccgg

SEQ ID NO: 143087 - DNA, 721 bp, Homo sapiens
  misc_feature: GYAE6OF02IGOHU.46.67.G01.1.454.CMB.1.raw
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggcctttcggacgtacccctgtcccctcaccgtgccgcttcgtctcgtggtcgccctcatcagttagttcggtttctggtgggcttcgggtcccgnacgccctaccggagggaacgggtcgtaggaatacgtagtggaagtgtctactntagtagtggtacgttcctagttacgacgttccgtctctacgaagtagtagcgtacacgtatacgtctcgtagacctacgcaagtacaacttcttaacgttttcccaggtaagtacgtgtacgtttcgtacggtaccgtacccgtccgtcgtacggtaccggtaacggggttcttttaacgtacgttcggtacggacgtaaggtacggtaccgttattaagtttagttcggtttaaggtttttagggtagttttacgtttaacgttaccgtaaccgtacccgtagttaaccgtccggggaccgggtccgttacccggtacccgggtacggggtacccgaaagggttctaaccggttccggttaccgtaccccgttaccgtccgttacccgtcccgtaacccgg

SEQ ID NO: 143088 - DNA, 845 bp, Homo sapiens
  misc_feature: GYAE6OF02JH1HN.46.67.G01.1.454.CMB.1.raw
  modified_base (212)..(212): a, c, t, g, unknown or other
  misc_feature (212)..(212): n is a, c, g, or t
  modified_base (261)..(261): a, c, t, g, unknown or other
  misc_feature (261)..(261): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgacggtccttcggagaccctgtccctcacctgcgctgtctctggtcgcctccatcagtagtgttcttcgtgggctgggtccggnacgccgtcccgaggggagggtcgtggaactcagttggtaagtgtctctnactagtaggacggttacctattacgacgtccgtcgtctacgagtagtacgtgaccactactactctcgtacgacgtaccgtaccacgactaacgttcgttaaccgttttcccgaagtaagtacgtacggttcgttaccgttcggttacggaaccccggtcgtacggtaccgtaaccggttaccggggtttaccttttaacgttaccgtacggttacgggaccggtaacgggtaccggtaacggttaaccgtttaagtttacgttaggtttacgttttaggggttacggttttacggttttacgttaacccgttacccgtaacccggttacggtaaccggttaccggggtacccggggtacccggttacccggtaccggtacccgggggtaccggtaacgggtttacccggtacggttaccgggttaaccccgtacccgttcccgttaaccgttaccccgtaccccggtacccgaacccggtacccggttacccgtaccggtttaccccggttacccgttaccccccggtacggtccccctacccccggttcccgtaacccggtaacccgtacccgttaccccgg

SEQ ID NO: 143089 - DNA, 663 bp, Homo sapiens
  misc_feature: GYAE6OF02JA1QO.46.67.G01.1.454.CMB.1.raw
  modified_base (458)..(458): a, c, t, g, unknown or other
  misc_feature (458)..(458): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcaccgtgcgctgtctcgtggtgcctccatcagtagtggtttcttcgtggggctgggtccggcaggcctcccggagggaacgggctgggaaatacagttggaagttgtctcgtacaagtaagtgggtaggttcctaagttacgagttcccgtcgtctacaaagtgtcgaagtccaccaattactctacgtggaactacgtaccagctaagtctaacgttttcccagaaagacttagagttacgtgtacgaaccgccgtctagaacgacgggttatttactagtcgtgacgagtagacgtctaattagngttagttttaggtacgtgttacttacgactaccctagacgtggaccgggtntaccggaccgtcgggacgaaggtaaccgtacgtacggtaccgtaacgtcgttacctacgtcccttaccgaaccgtaaccgggacccttacggtccggttacccgttaccccgtccggaccctaacccgtcccgtaaccgaacggacgtaacccg

SEQ ID NO: 143090 - DNA, 733 bp, Homo sapiens
  misc_feature: GYAE6OF02FKGZ9.46.67.G01.1.454.CMB.1.raw
tcagactagcagtacacgaccggtgctcgatttagagtatacatattgggtttggggagtctcggtcaggacacagcatggacatgagggtcccgctcagctcctaggggctcctgctactctggctaccgaggtcgccagatgtgacatcggagctcgacccagtctaccactccctccgtgtcagtaccgaaccggttgggaacactagggttcgtaccaaccgtattcctaacgtttcgggccggggtactaaggtaccgaaatacgttacggaccctaaactttaagttttaaaacggttcggtaactactaaacgtataacggaccgaacgggaccggtacccctaagtccttacctaacgtccttaagtcgcttcgacgtacgtaccgttagtttacggaacgttaacggtaccgggttaccaggttaccggtaggttacgacggtgacgtaggtcggtaatcggtaggaatacggttacttacgactactaccgacgtactcgtaagttactcgacgtacgtaacggtcgtaaagttgttactacttaactttaactcgtactaacgtaacgtacttaacttagtactttacgttacggaaccggtaaacggacctaaacggttacaaaacttaaacgttaaacgacgtttagtaagtcgtagaccgttaacacgttactccgttacctagttacctttacccgtaccgactaccgtatcgtaacg

SEQ ID NO: 143091 - DNA, 1036 bp, Homo sapiens
  misc_feature: GYAE6OF02FSHGI.46.67.G01.1.454.CMB.1.raw
tcagactagcagtacacgaccggtgctcgatttagagtatacatattgggtttgtcctcctgctggtggcagctcccagatgggtcctgtccctggtgcaactgcgaggagtcgggcccacgactggtgaggccttcggagaccctgtccctcgacctgcgtctgtctctggtcgcctccatcagttagttggtttcttcggtgggtctgggtccgcacgcctaccgaggggtagggtctaggaatacgtagttgggaatcgtactcgctaagtacggttcggagtttacctattaccgacggttcccgttacttaccgtacaggacgtacgagttcccaacctagttactccgttacgtacggaaccttaccggtccgtaagacccgttaaagtccccgtttaaaccggtttttaccccgagggtaaaaccgttggtaccggtttaacggttttaccttacggggtacccgtacccgggtacccgttaccgtaacgggtaaaccgggttacccgggggttttaaacgtttttacggtttaacccgttagggttaccggaacggtaaccggtaacggggtaaccggttaacgtttaaacgttttagtttaacggttttaggggtttttaaacgggttccgggtttttaggtttttaaaacccgttttaccccgggtaaaccccgttaaaccgttttaacgggttacccggttaacccggggggttaaccggggttcccggtttaaacccccgggtaccccgggggttaaccgggggtaacccgggtttaaccggggttaaacgttacccgggtttacggggtttaacccccttacccgggtttcccgtttaaccccgggttacccgtacccccggttaaccccggtaaacccgggttaaacccggggtacccccgggttttaccggttttacccccccgggtttcccccgttaacccccggtttaccccggaacccccggttacccccgtttacccccggaaccgttaaccccgggggtacttaaacccccccggg

SEQ ID NO: 143092 - DNA, 656 bp, Homo sapiens
  misc_feature: GYAE6OF02FXA7K.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgactaccttaatttaaattggtatcaacatacgaccagggaccggcccctaagctacctaatctatgctgcatccctagtttacgacgtaaggtcggggtaccctagtcggtagttcagtggactagtggatcgtagggactaaggtatttaccacgttctacccgtaacctactacgtaagttaactacgtacggtacaaacggttagaagttacttttgaaccttaaactttacttaacgttacgtactaaacgtaacgtaaactttaactaagtttacggttttaacccgaccggtaaaggtaccaacgtaaccttaaactaaaacgttaaaccgaagttacggtggtacttacgaccttaacctattccgttacttaccgttactaccttacccgttaccccacttacgttacctagttacc

SEQ ID NO: 143093 - DNA, 800 bp, Homo sapiens
  misc_feature: GYAE6OF02GIKK8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccaggtcctccatcctccctgtctgaccgaaccggtggaagaccagtcgtaccacctatccacgttcgcccgggactaagtccggaaactattacggaacctaaccgttaagtttaaacgttacggtactacaaacaagtacgaaccggagggaaccgtacccctaagcctactaactactatcgtctagactacgtacctacgtttacgacgtaacgtcgggtaccctaagtcggtacggttacgaggtggtacgtaggtacggacttcggtaacgggaactaggttacctttaaccgaccgttaccctacctaaccgtaacttaacgtaacgttaacgtttccgacggttaaacgtaacgggttaacggtaaacgttttacgttttaaaccggtaacctttaaaccgtttaccgtttaaccttacgttaaacccgtaaaaggttaacttaaacgtttacctaagggttttacccggtttaaccgggaacgtaaacggggtaacttaaaccggttaaccgtaaaacttaaaaccgttaaaccgtaagtacggttacggtacgtaaccctactaacgttcgttacctaccggttaacttctaccctttaccggtacctaacggttacttcgaaccgttaccg

SEQ ID NO: 143094 - DNA, 771 bp, Homo sapiens
  misc_feature: GYAE6OF02IPT4P.46.67.G01.1.454.CMB.1.raw
  modified_base (269)..(269): a, c, t, g, unknown or other
  misc_feature (269)..(269): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattgggtttgtcctcctgctggtggcagctcccagatgggtcctgtccctggtgcaactgcgaggagtccgggcccacgctggtgaggccttcggagaccctgtccctcacctgcgctgtctctggtgcctccatcgagtagttggtttcttcggtgggtcgtgggtccggcacggcctaccgaaggggagggctagggaattacagttaggaagtgtctactanagttagtggtaggttaccttattaacgacgtccgtctacctacgaaggtacgtccgtagtccaaccgatacgttacctacggtacggtacctaaccgtaccaagtacctaacttacttacgtttttcccaggtaacgtatcggtaatttcgtacgtcggacccgcgngtacgacggtacgggtacgtttaagttaccgtggtcgacggacggtacggtaacggtacttaacgttacgttagggttttaagttttgggttacggtttacggttttaacgtttacccgtacctttaaccggtaacggtaccgtttacggggaccgggtccgttaacgggccccggtacggggaacccgtaagggtaccgttagttccggtaaccgtaccgttccgtaccgttacgtcccgtaccgaacccggtaccgggtaccctacgttacccggttccccgtttcccggccgttaacccgtccccgttaccgtaccgacgtaccgtacccgg

SEQ ID NO: 143095 - DNA, 775 bp, Homo sapiens
  misc_feature: GYAE6OF02IPJFN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccactccctcccgtgtctgaccaaccggtgggacgactagtcgtaccaccatcacgttcggccgggactaaggtacggaactacgttacgacctaacctttaatttaaacgttggtaactaccgaaacgtatacggaacccggacggggacccggtacccctaaagtcccttaccgttaaatcctaagtcgtacctacgacctagttaccgtagtttcgaacggtaaacgggttccggggtaccctaagttcggtacggttacacgggtcggacgtagggttcggtacgtacggtacgggaactaacggttactttaccaccgttacgtacccgtaaccgtaagttaccgtaaacggttaacttccggtaacggtaaccgttaaaccggtaggttaaacgtttacgtttaacggtaactttaaaccgtttagtttaacgtttaacgtaaccgtaaagtaaacgttaacttaacgtaagttttccgggttaaccggaaccggttaaaggtaaccttacgaaacttaaacgtaaacgtaacgtacgtgtacgctacgacctacgtacttcgtcttaccttacgtacttcccgtacctatactctactacg

SEQ ID NO: 143096 - DNA, 748 bp, Homo sapiens
  misc_feature: GYAE6OF02F1UG1.46.67.G01.1.454.CMB.1.raw
  modified_base (269)..(269): a, c, t, g, unknown or other
  misc_feature (269)..(269): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagttgttggtttccttcgtgggcgtcgggtccggcacgcctcccgaggggtaagggctaggaactacgagttggaagtcgtcgtcctanataggtggtacgttaccttattactacgtccttcgtctacaaggtgtcggacgtcctaaccacttctcttacgtacggacctaccgtcacgctacttcgttaccttttccgacgtaagtagtagttacgttcgtagttccgccgtccgtacgtcggtaccggtacggttacgttttacttacgttacgtcgacggtagtacgtcggtacttagtttacgttagttttaggtttcggttaggtttacggtttacgtttccgtaaccgtaccgttaaggtcggttaaccggggcccgggttaccggtacccggtaccggttcggggaccgtaacggggttacgttaccggttcgttcccgtacccgttacttacccgttccgtaccccgaccggtacccggtaccggtacccttccggtccccggtttccccgtccccgtccgtaccccttaccccgtaccctaccgaacgcccttacccg

SEQ ID NO: 143097 - DNA, 626 bp, Homo sapiens
  misc_feature: GYAE6OF02G6875.46.67.G01.1.454.CMB.1.raw
  modified_base (212)..(212): a, c, t, g, unknown or other
  misc_feature (212)..(212): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttcttcgtggggctgggtccggnagctcccgaggggaagggctggaatacagttgggaagttgtctctcataggtggtaggttcctattacagtccgtctctcaagagtcgagtcaccatctctctggacacgtccagcaatcacgttttcccagaagntgagttctgtcgacccgtcgactcggacgacggggtcttttaattaccgtggttcggacggtaagacggtaccggtacttaagttagttggttagtttttagggagtttggtttactttcgaacctacccgttagtacgtcgggaccggggtctacccggaccccggtggggacccgagggtactacgtgtccaccgtctccgtacgccctaccgaccgaacggtccctacgtccgtcccttccccgcgtccctacccttaccaccgagtccgacccg

SEQ ID NO: 143098 - DNA, 1013 bp, Homo sapiens
  misc_feature: GYAE6OF02GXA37.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgacccctgtcccctcacctgcgctgtctcgtggtcgcctccatcaggttagttcggttttccttcggtcgggggtcgttcgggggtcccggcacggtcccgtccccgggaaggggggaacgggggtccgttagggaaacttaaccgtaggttacggggtaaggttcggttccttacgtacgtaacggttagggttacgggttaaccggttttacccttaagtttaaccgtaacggtttccccgttacccttactaccggtaaaaggtacgttaccgggtaacttaacccaaacccgttacttaaccttccgttaccggtaccgggtaacccgtaccggttacccgaacgtacctaaacttaccgtttaaccgtttttcccccggtaaggtaacgttagtttacggttacggtttaccttcgggtacccgaacccgggtcccgttaccggttacgggaaccggtttaaccggggtttacgtttttaacgtaccggtttaggtaccgggaccggtaagggtaaccgttacggtaacgttttaagttacggtttaggttttaggttttagggttagggtttacggtttacttaaccggtacccgtaacggttaggttaaccggtccggggtaccggggttcccgtacccgggtacccgggtacggggtaccgggtaacggtaacccggttacggttacccgtaccggtttaccccgttaccccgttaccgtaacccgtttccccccgaaccgggtaacccggtaacccccggggttacccgttaacccgggtcccccggtttaccccggttcccccggtaacccgtacccccgttcccctaacccccgtaacggtaccccgtaccggtaccccccg

SEQ ID NO: 143099 - DNA, 741 bp, Homo sapiens
  misc_feature: GYAE6OF02HNYO1.46.67.G01.1.454.CMB.1.raw
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcggagaccctgtccctcacctgcgctgtctctggtncctcatcagtntggtttctcgngggctgggtccgnagctccagggaggctgatcattgagtgtctctcatgtgtacgttctagttacagtccgtctctacgaagcgtcgagtcaacctatactctcgtacgactaccgtcagctaacgtctaacgttttcccagaacgtntagtacgttctcggtacgacccgtccgtacgtcgtaaccggtaccgggttacgttttaacttacgtggtcgacgtaacggtacggtaaccggtatttaagttaacgttggtttaaggtttttagggacggttttacgggttttaacgtttacccgtaaccgttaacccgttaggttaaccgttcccggggtaacgggggttccctaccccgggttaccccggtacggggacccggtaaacgggttaacttaccggttcgttaacccgttacccgtccgtttacccgttaccgtacccgtaaccgaaccccggtaacgggtaccccttacggttcccggtttccccttaccccggtcggtacccccttaccccgtacccttaccgaaccggcctaaccccgg

SEQ ID NO: 143100 - DNA, 724 bp, Homo sapiens
  misc_feature: GYAE6OF02FY1PP.46.67.G01.1.454.CMB.1.raw
  modified_base (148)..(148): a, c, t, g, unknown or other
  misc_feature (148)..(148): n is a, c, g, or t
  modified_base (699)..(699): a, c, t, g, unknown or other
  misc_feature (699)..(699): n is a, c, g, or t
tcagactagcagtacacgaccggtgctcgatttagagtatacatattgggtttggggagtctcggtcaggacacagcatggacatgacgggtccccgctcgagctccgtggggctcctgctactcgtggctccgaggtgccagatgtnacatcgagctgacccagtctcatcctcctgtctcgcgaaccggtgggacacgtaggtcgtaccacctatacccgtagttccgggacccgggtacaacggggtaccggaaactacgttacgaaccttaacccgtttaatttaaaggtttcgggtaacttacaaaacgtataaaccggaaccggaaacgggggtaccccggtaaccccgtaacggtcctaaacccttaacgttactaacgtcggtctacggtaccgtacttaccgtaggttttacgaacgtaaacgggttccggggccctaaggttccggtacggttcgaaggtcggtagtagggtcgtacttcggagggactcgttaacttcaacgttccacgtaactaccgtatacgtaactcgacgtacgtaaacgtagtaagttacgtttacaaccttaattacgttacgttactaactacgtaagttaaactacgttagttacgttacggaacgaggtactacgtaacaaacgtaataacggtagttgacgtcacgacctcgtatcgtacgttctacncttcccgtaccagtctcgtactacg

SEQ ID NO: 143101 - DNA, 898 bp, Homo sapiens
  misc_feature: GYAE6OF02FVR3Y.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctcgtggtcgcctccatcagtagttcggtttcttcgtggggtctgggtccggcacgcctcccgaggggaagggctaggaactacgtagttagggaagttcgtcctccgtacaagttaggtgggtacggtttcccttaattaccgtacgttcccgttctcctacgaacggtacgttaccggacgttccaacccgttattaacttccgttccgtacgggtaacctacccggttaccgaacgtaccgtaaactttcccgtttaaccggttttttccccgtaaggtaaagttacggttaggtttaaccgtttccgtttacggtaccggtaacccggtcccgtacggtaccggtaaccggtaccggggtttacgtttttaacttaccggtggttcggtacgggtaacggtaacggtaccggttacgtttagttacggtttagttttaggtttttacgggtaggttttacgggtttacgtttaaccggtaacccgtaaccgttaagggtaccggttccgggggtacccggggtcccgtaccccgggttacccgggtacggggtacccggtaacgggttaaccgttaccggttcggttacccgttacccggttccgttaacccgttacggttcccctaacgaaccccgttaacggggacccttaccgggttccccgttccccgttccccggtacccgtacccctaccccgttacccgtaccggtaaccggcccgtaaccccgg

SEQ ID NO: 143102 - DNA, 893 bp, Homo sapiens
  misc_feature: GYAE6OF02GE63Z.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagagtcgggtcctcgtcccgtggtgaccaactgcgaggacgtccgggcccacgtacgtgggtgacggtccgttcggacgtacccctcgtcccctcaccgtggccgtctcggtcctcgtggtcgtcccttacacgtcgagttacggttcgttttccttcgggtagggggtccgtcggggtacccgcgtacgtcccgtacccggagggggtacgggtcgtaggtaactacgtacggttaggtaacgtcgtcctcgtacgtaaggttacggtaggtaccggttaccttacgttaccgtacggttcccgtcttaccgtacgaacggtacgtccggacgttacctaaccgtacttacttccgttacgtacgggtaacctaccggttaccgacggtaactaaacttccgtttacgttttacccgaaggtaacgttcgttacggttcgtttaccgtaccggtaccgacccggttccgtaccgtaacgggtaaccggtaccggggtttaccttttaccggtaccgttagggtacggacggtagtaaccgggtacgttactttaggtttacgtggttttacggttttacgggtacggttttacgtttacccgttaccgtaacccgtacccgttaaggtaccgggttaccgggtaccgggggacccctttaccccggggtcccgggtaaccgggtaaccgggttaacgggttaacgttacccgggttccgggttaaccccgtcccgggtttcccttacccgggttacccgtcccgttaaccccgg

SEQ ID NO: 143103 - DNA, 724 bp, Homo sapiens
  misc_feature: GYAE6OF02H7UGB.46.67.G01.1.454.CMB.1.raw
  modified_base (178)..(178): a, c, t, g, unknown or other
  misc_feature (178)..(178): n is a, c, g, or t
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
  modified_base (437)..(437): a, c, t, g, unknown or other
  misc_feature (437)..(437): n is a, c, g, or t
  modified_base (699)..(699): a, c, t, g, unknown or other
  misc_feature (699)..(699): n is a, c, g, or t
tcagactagcagtacacgaccggtgctcgatttagagtatacatattgggtttgtcctcctgctggtggcagcctcccagatgggtcctgtccctggtgcaactgcaggagtccgggcccacgactgggtgacggccttcggacgaccctgtccctcacctgcgctgtctcgtggtcncctcatcagtagtcggtttctcggtgggtctcgggtccgacacgccgtaccggaaggggagggctaggaatacgtagtaggaagtgtctcnagtagtggtacgttctatntcgtcctctctagaagtctcgagtaccactatactctgtacggactaccgtccagaactatccgttaacgtttccgagtaagtntacgtacgttcgtagtaccgaccgtccgacgtacggtaccggtacggtttacgtttacgttacgnggttaacggacggtaaggacggttacgtacttttaaggttacgttaggttttgtttacgggtagttttcggtttactaccgtaaaccctacgaaggttacgtcccggggtacgggtaccctacccgggtaccgggtaccgggaagtaaccgggtcctacggtttacccgcccgttacgttaacccttccgtacccgtacccttccggaaaccgtccgggtaaccctcgggttacccccgttcccgtcccggtccgtaacccnccctaacccgtacgacctcgtcccg

SEQ ID NO: 143104 - DNA, 815 bp, Homo sapiens
  misc_feature: GYAE6OF02I4WVW.46.67.G01.1.454.CMB.1.raw
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctaggggctcctgctactcgtggctccgaggtgccagatgtgacacgtcgagctggacccagtcgccatcctcctgtctgaccgtaccggtgggactacaggtcgtacgacctatccacgttcggccggactaaacggtcgaactagttcgaacctaccttaaattttaaacgttggtactacctaaactaacgttaacggacccgaacggggtaccgacccccgttaaaagtcccgtaacctaaacttccttaacgtcgtaccgtgtacctaacgtccgtaggtttacggaacgtaaacgggttccgggttaccgagttacggtacggttacggacggtggacgtagggtccgtagcggttaacggtacgtagtactttaccgaacgtcctaccgactancgtaacgtaactcgacgtaacgtaacggtaggtaacgttacgtttacgtaacgttaacgtttactacgttaaggttaacccaaagttaaccgtaaatttaccgttaaacgtttcccgggtttaaaccgtaacgggttaacccgggttaactaaccggtttaaaacgttaaacccgttaaaaacgtttaaacggtaaccggtttaggaaccgttacggtaccgtaaaccgtccgttaaacggtttcccttgtttaacccgttactttacccggttccccttaccggacttaacccgtagtttaaccggtac

SEQ ID NO: 143105 - DNA, 663 bp, Homo sapiens
  misc_feature: GYAE6OF02HQ14O.46.67.G01.1.454.CMB.1.raw
  modified_base (143)..(143): a, c, t, g, unknown or other
  misc_feature (143)..(143): n is a, c, g, or t
  modified_base (314)..(314): a, c, t, g, unknown or other
  misc_feature (314)..(314): n is a, c, g, or t
  modified_base (657)..(657): a, c, t, g, unknown or other
  misc_feature (657)..(657): n is a, c, g, or t
tcagactagcagtacacgaccggtgctcgatttagagtatacatattgggtttggggagtctcggtcaggacacagcatggacatgagggtccccgctcagctcctgggctcctgctactctggctcgaggtgccagactgtnacatcgagctgacccagtcctccgactcctccctgtctcgactaaccggtgggacacagtcgccacctatctacgttcggcccggataaggtcgaactatcgaactacttaatttaaagtgtatacaactaatacgaccgaggaccgtaccctaagcctacctaatctaancgacgtgacctacgtaccgtagtttacgacggtaaacggttccgggtaccaggtccggtagttacgaggtcggacgtaggtacgtacgtacggtaggaacctagtacgttccacgtacctccaccgtatactaagtacgtcgtagaaccgtagtacgtaagttgtttaacgacttaacttagtactacgttaactaagtaaactaacgttacgttacgttcggttaccgaacggttacgaactacgtaactaaacgtaaacgttaacgaacgtgtacgtctaacgacgtactccgttacgtcttaccttaccgtacgtccccgtcgtaccctacgttaccgtntaaccg

SEQ ID NO: 143106 - DNA, 853 bp, Homo sapiens
  misc_feature: GYAE6OF02JE7ZV.46.67.G01.1.454.CMB.1.raw
  modified_base (200)..(200): a, c, t, g, unknown or other
  misc_feature (200)..(200): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtccttggagaccctgtccctcacctggcnctgtctcgtggtcgcctcatcgagtagttcggtttccttcgtcggggtctcggggtccggacacggtcctacccggagggggaacggggtcgtagggaactacgtacgttagggaacggttcggtacttcgtacgtaagttacgggttacggggtaacgggtttccctttaacgtttaaccgtaccggttacccgttccgttaccgttaccgaaaggtacggtaccgtacggtacctaacctaattacgtccgttccgtacggtaccgtaccgtaccgtacgactaacgttccttaacgttttacccctaaggtaacgtagttacgtacggtttacgtcgtacgggtcccgtccggtcgtacggacgttaccggggttcgtttaacgttcgttggtacgtacggacggtaacgggtaccgtacggtttaatttacggtagttttaaggttttcgggttaaggtttacggttttacgtttaaccgtaaccgtaaccgttaacgacggttaccggggtacggggttacccggttacccggtacccgggggttacccggggaccggttaacgggtaaccggtttaccgttacgggttacccgtttaacccgggttccgtttaccccggttaaccggttaccccgttaacccccggg

SEQ ID NO: 143107 - DNA, 789 bp, Homo sapiens
  misc_feature: GYAE6OF02JLY8X.46.67.G01.1.454.CMB.1.raw
  modified_base (146)..(146): a, c, t, g, unknown or other
  misc_feature (146)..(146): n is a, c, g, or t
  modified_base (172)..(172): a, c, t, g, unknown or other
  misc_feature (172)..(172): n is a, c, g, or t
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
  modified_base (777)..(777): a, c, t, g, unknown or other
  misc_feature (777)..(777): n is a, c, g, or t
tcagactagcagtacacgaccggtgctcgatttagagtatacatattgggtttgggggagtctcgtcaggacgacgagtcactggacactaggacgggttccccgcttcgagctcctggggctcctgctactctggctccgagtcnccagatggtcgacaagtcggtacgtntcggaccctagttctaccgtctccctccttggtcctaggccgtaacggtgggtacgacgtacggtcgtccaaccgtactccgacgttcggggcccggacaacggtaccggtactacgttcgacctaaccgttaagtttaaacgttcggtaacttaccaaaccgtaagtacggtaaccgtaacggggtaccggtacccctaacggtccggttacctaaactcgtactcggacgcggtgtactaccgtgtttacggactaaacgggtcggtaccagtacggtagttacgagtcggacgtaggttacggtactcggtagggaanaggttacgttccgttacncttaaccgacacgtttagaacgttaaccgtctaacgtaacgtaaacgttcggtaattcgtttaactaactaccgttaataccggttacactaacgtactaagttaacgttagttacggtacggaaccgtaacggtaccttaacgtaacgttaaactaaagggtaaccttaagtggtaacgtcgttaaacgaccttaacggtaacctttagggttcttaaaccgtttccgaaccggttcccgttacccggttaacctcggtttaccnggtttaaacccg

SEQ ID NO: 143108 - DNA, 850 bp, Homo sapiens
  misc_feature: GYAE6OF02I45RD.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctccatcagtagtggtttctcgtgggctgggtccgcagtcctcccgaggggagggctaggaatacgtagttggaagttcgtctcgtactagttaggttgggtacggtttccttaacgttacgtaccggttccgttccttaccgtaccgtaaaggtacggttaccggtacgttaacccaacccgttaacttaacgttccttaccggttaccgggtaaccgtacccggtaccctaacggtaacctaaaccgtttaccgttacgtttttaccccgtaaggtaacgtacgtttaggttaacgtttcgttacggttaccggaacccggtcccgtcgtacggaaaccggttccggggttaacgtttttacgttaaccgttcggtacggtacggtaacggtaacgggtaccggtacgtttaaacgtttagttagggtttacgtttttagggtacggtttagtttacgttaccgtaacgtaccgtagtacgtacgggcgggtaccgtccggtacccgtacggggaccgtagggtaactacgttccggtaccgttaccggttaccgtttaccgttaccgtacccgtaccgtaacccggtaccggtacccgttacggttcccgttacccccgttacccgtcccggtacccttacccccgtccgttaacccgaacggttaccgtaacccg

SEQ ID NO: 143109 - DNA, 753 bp, Homo sapiens
  misc_feature: GYAE6OF02FW1FM.46.67.G01.1.454.CMB.1.raw
  modified_base (137)..(137): a, c, t, g, unknown or other
  misc_feature (137)..(137): n is a, c, g, or t
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagactagcagtacacgaccggtgctcgatttagagtatacatattggggtttggggagtctcggtcaggacacagcatggacatgagggtccccgctcagctccgtggggctcctgctactctggctccgaggtnccagatgtgacatcgagctcgacccagtctccatcctcctgtctgccaacggtgganacngtcgtccacatctacgttcggccgggataaggccggaactnttacgacctaaccgttaatttaaacgttggtaactacaacgtatacgaccggacgggaccgccctaagctactactntacgtgctcgctactacgtagttagaacgtaacgggtcgggtaccctagtccggttaggttccgtaaggtcgggtactaggggttcggaacttccgggtagggtaaccctaaggtttactttaccacggttccctaccgtacgtacgttacgtaacgtttaactcgtaacgtaccgaaagggtttcgtaactttaacggtttacgacctttaacttacgttacgtacgtactaacgtagtaacttggaactttacgtttcgggttaaccgtacggaacgttaaacgaaccgtaaattaaaaccggttaaacttaaacgggacctttacgggtacgtacccgttaacgtaccgttaaccgttacctttaacggttcttttaacccctgtttaaccccggttaacccgtttacccaccgtttacggttaaccccttaagg

SEQ ID NO: 143110 - DNA, 521 bp, Homo sapiens
  misc_feature: GYAE6OF02HJF0Y.46.67.G01.1.454.CMB.1.raw
  modified_base (248)..(248): a, c, t, g, unknown or other
  misc_feature (248)..(248): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacatgacactattaaatgtatcaanatagacgagggacgacccctaagctctaatctatagctgtcatcctagtttcgacaaagggtcgggtacccagtcggtaggtcagtgtcagtgatcgaggacatattcactctcactatctagtatcngactagtagatatttgactaattatatgtacataataactatattgttacggacgaaggactaactaacctaactaaactaacgacgttcgacgtactcgacactagtcttacgtcttctacttcctaccgtctactcgtatacc

SEQ ID NO: 143111 - DNA, 759 bp, Homo sapiens
  misc_feature: GYAE6OF02HF3H8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtgtttctcgtgggctgggtccgcagctccgaggggagggctaggaatactagttggaagttgtctctacagtaggtggtacgttctatacgagtccgtactctacgaagtgtcgagtccaacctagtacttcgtacgtcggaacctaccgtccaagtacctaaacgttccgttaccgttttcccgtaggtaagtacgttcggtacgttcgttacggtccggacccggtccgtcgtacggaaacgtaccgggtttagttttacgttaccgtggtacggacggtacggtaacggtacggtacttaagtttagttagtttaagttttagggttacggtttgtttacgttaccgtaaccgtacccgtagtacgggtaccggtacggggtccctacccggtacccgggtaccgggtccgtaacgggtaacgtacccggttacggtacccgttacccgttcccgttaccgttcccgtacccgtacccgtaacccggaaccggtacccgttaccggtacccgttccccgttaccccggtccgtcccctaccccgttacccgtacccgacgcccggtacccg

SEQ ID NO: 143112 - DNA, 643 bp, Homo sapiens
  misc_feature: GYAE6OF02FT4QX.46.67.G01.1.454.CMB.1.raw
  modified_base (212)..(212): a, c, t, g, unknown or other
  misc_feature (212)..(212): n is a, c, g, or t
  modified_base (290)..(290): a, c, t, g, unknown or other
  misc_feature (290)..(290): n is a, c, g, or t
  modified_base (403)..(403): a, c, t, g, unknown or other
  misc_feature (403)..(403): n is a, c, g, or t
  modified_base (508)..(508): a, c, t, g, unknown or other
  misc_feature (508)..(508): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtnccctcatcagtagtgtttctcgtggggctgggtccggcagcgtcccgagggaggggctggaatacattggaatgtctntctagtgtggacggttcctatacgcgtcctctctcgaagagtcgagtccaccatatctcgtgacaccgtaccagactaactcctagttttcccaggtaactatgtacgtttcnggttccgaccgtcgtactaggaccgtacggggttctttaagttaccggttggtaggcgtaacggtacggtaccggtctttaattactggttacgtttttaggggngtttacgttttcgttcgtaacctacccgttagtacgttcgggacggggttccaccgggtccccggtgggccggtaaggtaacccgttggtccggtaccgtacccggttccttacccgttaccgcccttaacccgg

SEQ ID NO: 143113 - DNA, 857 bp, Homo sapiens
  misc_feature: GYAE6OF02HNY5A.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgacaccggtggagacagtgtaccaccattcacgttcggaccgggactaacggtaccgaactacgttacgaacctaacctttaagttttaaacgttggttactacctaactaagtaacggaaccgaacggggtaccccgaccccgtaaacgtccttacccttaaattcctagttacgtcctacgtaccgtactacccgttaggtttacggaacggttaaacgggttccggggttaccctacggttaccggtacgggtttacggtacggtcggtacgtaagggtacgtacggttaccggttcggggaaacttaggttaaccgttttacctaacctttccgtaccctaaccgtaagttaccgtaacgttaacttcccgtaaggtaacgttaaacggtaggttaaacgttacgttttacgtaacctttaaaccgtttaacgttaccgttacgttaaccgtaaacgttaaacgttaacttaaacgtttaaccgtttacggtttaaccgggaaccggttaaccgggaaaccgttaacgttaaaacttaaacgttaaaacgttttaaaaccggtaacgttacggtacggtaccgttaccggaaccgtaaccgtacgttactttccggttaacctttcgttaccgttacccgttaccccgttacgtaccttaccgtaagtaaccg

SEQ ID NO: 143114 - DNA, 687 bp, Homo sapiens
  misc_feature: GYAE6OF02IFIEA.46.67.G01.1.454.CMB.1.raw
  modified_base (234)..(234): a, c, t, g, unknown or other
  misc_feature (234)..(234): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (477)..(477): a, c, t, g, unknown or other
  misc_feature (477)..(477): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttgggggagtctcggtcaggacacagcatggacatgaggtccccgctcagcctccgtggggctcctgctactctggctccggaggtgccagtatgtgacatcgagctgaccctgtctccatccctccctgtctgccgaacggtgggacactagtgccacctatccacgtttcggacccggganaaacggtcgggaaactacgtttacgaacccttaacgtttaattttaaaagtttcggtaacttaacaaacctaaggttaacggacccggaacggggaaccccggtacccctaaagtccctaacctaattacctagtcgactgcctatccctaggttttcgaagtaaccgggttgggtaccctagtcggtaggttcgacggtggcgtaggtcgtactgtacgagtactntacnctcagactatanatactcgatatagagtagtnttagacttactagtactacggtaacactaaagttacttaacgtacggtttaggttacccggacggaaacggttaaccaacgtaacttaaacgtaaacggttaaacctaagtcgcgtaacgttcaacccgtagttactccggttaacgttcttacctacgtttacccgtactccgtactacgttcctaacg

SEQ ID NO: 143115 - DNA, 657 bp, Homo sapiens
  misc_feature: GYAE6OF02HGB16.46.67.G01.1.454.CMB.1.raw
  modified_base (180)..(180): a, c, t, g, unknown or other
  misc_feature (180)..(180): n is a, c, g, or t
  modified_base (211)..(211): a, c, t, g, unknown or other
  misc_feature (211)..(211): n is a, c, g, or t
  modified_base (330)..(330): a, c, t, g, unknown or other
  misc_feature (330)..(330): n is a, c, g, or t
  modified_base (528)..(528): a, c, t, g, unknown or other
  misc_feature (528)..(528): n is a, c, g, or t
  modified_base (592)..(592): a, c, t, g, unknown or other
  misc_feature (592)..(592): n is a, c, g, or t
  modified_base (605)..(605): a, c, t, g, unknown or other
  misc_feature (605)..(605): n is a, c, g, or t
  modified_base (629)..(629): a, c, t, g, unknown or other
  misc_feature (629)..(629): n is a, c, g, or t
tcagactagcagtacacgaccggtgctcgatttagagtatacatattgggtttggggagtctcggtcaggacacagcatggacatgaggtccccgctcagctcctggggctcctgctactctggcctcgagtgccagtatgtgacagtcgagctgacccagtcctccatccctcctgtcngccaacggtgagacagtgtaccacctactcncgttacgcccggaactaaggtaccgaactattcgaactaaccgttattaaatcggtactacgaatactaacggaaccgacggaccgaccccctaaggcctaactaatcctagtaccgtntcgacacgttaccgtaggttacaacgtaagggtccggtaccttagaccggttaggttagacggttggactaggtaccgattccggaggtaaccaagttcttacccggacttacctccgaaactaacgtcccttaaaagtctactacggaaacgtagtaagtaacgttacgttataaccttaaacttagttatacgtanaaagtataaacttagtaggttactacggtaacgagtaaccaacggtaacttaaataaacgtaanacgttagcgtacngtaccatactacgtcttaaccgtntacttcccgtacaacgttctactgaacc

SEQ ID NO: 143116 - DNA, 962 bp, Homo sapiens
  misc_feature: GYAE6OF02I55ES.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgacggccttcgggacgaccctgtccctcacctgcgctgtctctggtcgcctcatcagtagttggtttcttcgtggggctgggtccggcngcctcccgaggggacgggctaggaactacgtagttgggaagttcgtctctacagttaggtggtacggtttcccttattaacgtcggttccccgttcttccgtactaaggtacggttcgtaacgttacccaaccctaattaaccttccgttccgtacggggtaaaccctaccggttaccccgaaggtaacccgttaaacttaccgtttaaccggttttttccccgaacggtaaagttacgttacggtaacgttttccgttacgggtaccggtaaccccggtcccgggtccgttacgggtaaccggtaccgggggtttaccgttttttaacgttaccgttcgggtacggtaccgtaagggtacggtaaccgggttactttaagtttacgttacggtttttaaggtttttacgggtaacgggttttggttttaaccgttttaccggaacccttaaccccgggttaaggtaccgggttacccggggtacccgggggtaccccgttaccccgggttaaccccggggttccggggtaacccgggtaaacgggttaaacccgtttaccgggtaccgggttacccggttacccggtttccgtttaccccgttacgtacccccgtaacccgtacccggaacccgggtccccttaaccgggttttccccggtttaccccccggtttccccggtacccggtacccccgttaaccccgttacccccgtaccggtaaacccgttcccgttaacccccgg

SEQ ID NO: 143117 - DNA, 801 bp, Homo sapiens
  misc_feature: GYAE6OF02I2ZXG.46.67.G01.1.454.CMB.1.raw
  modified_base (438)..(438): a, c, t, g, unknown or other
  misc_feature (438)..(438): n is a, c, g, or t
tcagactagcagtacacgaccggtgctcgatttagagtatacatattgggtttgggggacctcctgtgcaagaacatgaagcaccctgtggtttgtcctcctgcgtggtggcagctcccagatgggtcctgtccctggtgcaactgcaggagtccgggcccacgacgtggtagaggtccttcggacgaccctcgtccctcgaccttcgcgctggtcttcgtggtccgcctccatccgtagttacggttcgttttcttcggtcgggggtcttcgggtccgcgagtcccgtccggagggacgggctaggtactatacgtaggtaagtgttcgtctgtacgtagtggtacggttactagtttacgacggttccgttctacgtacgtaaagacggttacgaggtaccctaacctaacgttactccgttacgtacggtaaccnccggtcacgtaactaacgttacttcgtttacccgaggtaactagtggtacttcgtgtacgcccgtacgtccgtacgacgttaacgggttaccgtttacttacggttggtacgggtaccgaacgggttaacggtacccgtagtttaaccgttagttacggtttacggttttaggtttaagttaggttttacgtttaaccgggttaaccgttaccggttaggtaaaccgggttccgggttaccggggtcccggttaacccggggtacccccgggttcgggaaacccgggtttacgggtaaccttaaccgggttcccggtaacgttacccgttacccgtcggtttaccctcccgttaaaccccggg

SEQ ID NO: 143118 - DNA, 714 bp, Homo sapiens
  misc_feature: GYAE6OF02IQN70.46.67.G01.1.454.CMB.1.raw
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctcgggtccggcaggcctcccgagggggtaacgggctagggaatacgagttggaagttgtcctctcgagtaggtggtacggttcctattaccgagttccgtctctacgaagtacgtcgacgttaccaaccgtatactccgtcgtcggtacctaccggtcctagactaaacgttccgtacgtttttcccagtaacgtagtacggtagttcgtcgtacgcccggtaccgtgtacgaccgtacgggttctttagttccgtagtcgnggtacgaggtacgtnttagtctagttagtttggtagttcgttacgttcgaccgtacctgtaccgtacgggtcgggtacgtaccggtcccggtacggggaccgtagggtaacgttccggttccgtaccgtaccgttcccgttaccgttaccgtacccgttacccgacggtacccgggtacccgtcgttacccggttccccttacccggtacgtaccccgttaccccttaccggacccacggtaccgtacccg

SEQ ID NO: 143119 - DNA, 766 bp, Homo sapiens
  misc_feature: GYAE6OF02H8PZG.46.67.G01.1.454.CMB.1.raw
  modified_base (188)..(188): a, c, t, g, unknown or other
  misc_feature (188)..(188): n is a, c, g, or t
tcagactagcagtacacgaccggtgctcgatttagagtatacatattgggtttggggagtctcggtcaggacacagcatggacatgagggtccccgctcagctcctggggctcctgctactctggctcgagtgccagatgtgacatcgagctgacccagtctccactcctcctgtctgcaccgtgganacagtcgtcacatcacgttcgaccggacaaggtcggaactattcgaactaaccttaattttaaacgttggtaacttaccaaactaacgtaacggaaccgtaacggggtacccggtaccccccgttaaaggtcccttacccttaaacgttaaccgttaagtacgtcccgtacggttccaaccgttcccgttaaggtttttcgaaccgtaaacgggtttaccgggggtaacccctagttccggttaaggggttacctagggttcggaccggttaggtacggtacggtcgttacggggactaacgggttaactttcgacttacgttaccactacttaaccgtaagttacgtacgtacacgtaacgtacggtaaacgtttgttaacgtatttaaactttacttaacgttagtactaaacgtaattaacctttagtaacgtttacggttacgaaccggaagtaaccgaacgtaactaaacgttaaactaacgttaagtagtacgacgtacgagtaacctggttacctagtttaccttccgttaacttaccccgttccgacttaaccgttcgtaacggttaacc

SEQ ID NO: 143120 - DNA, 780 bp, Homo sapiens
  misc_feature: GYAE6OF02JAZB2.46.67.G01.1.454.CMB.1.raw
  modified_base (378)..(378): a, c, t, g, unknown or other
  misc_feature (378)..(378): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtcccctcacctggcgcttgtctcgtggtgcctccatcagtagttgtttcttcgtgggctcgggtccgcagcctccgaggggaggctggaatacgtagttgggaattgtctctcagtagtggtacggttcctattactacgtccgtctctacgaagagtcgtacgtacaccgtatactctcgtaggactaccgtcctacgactactaccgttacgttttccccaagtaacgtntaggttacgttcgtacggtccgacccgccgtccgtaggaccggtacgggttacgttttacttacgttagtcggacgtaggacgtaaccggtctttaaagtttacgttagtttaggtttttcgggtaaggttttacgggtttactttaacccggtaccgttaacccgttaacggtaccgggttacccggggtacccgggggtaccgtccccgggtaaccccgggtcgggggtaccctaacggggtaaccgttaccggtcgttaaccccggtaccgttccgtacccgttccgtaaccccgtcccgtaacccggtaaccgggtcccctaccggtttccgttacccccttccccggttaccgtcccccgtacccgttacccctacgtaccggtcccgtaaccccgg

SEQ ID NO: 143121 - DNA, 596 bp, Homo sapiens
  misc_feature: GYAE6OF02HQ7WW.46.67.G01.1.454.CMB.1.raw
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (413)..(413): a, c, t, g, unknown or other
  misc_feature (413)..(413): n is a, c, g, or t
  modified_base (570)..(570): a, c, t, g, unknown or other
  misc_feature (570)..(570): n is a, c, g, or t
  modified_base (589)..(589): a, c, t, g, unknown or other
  misc_feature (589)..(589): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacgagtgtcaccgtatccacttgccggcaagtcggaanattgacacttaatttaagtgtatacaanatagaccgaggaccgaccctaagcctacctaatctatcgactgacatacctagtttacgacgtaaaggtcgggtacccagtcgtagtcaggtgacgtgtggactacgtgggaactagtacgttccacgttccactactactactaagtatcgtanaccgtaagtagtaattatttcgaaccttaagttattaacgtctaacaaacgtagtaaacttactaagttcgtttacgacggtaaacggtactaacgtaactaaactaaagttaaaccgaattgacggtcagtaccaactgttacgtgttaccgttanccttaccgtcccactactntacgtac

SEQ ID NO: 143122 - DNA, 725 bp, Homo sapiens
  misc_feature: GYAE6OF02IP9OM.46.67.G01.1.454.CMB.1.raw
  modified_base (179)..(179): a, c, t, g, unknown or other
  misc_feature (179)..(179): n is a, c, g, or t
  modified_base (224)..(224): a, c, t, g, unknown or other
  misc_feature (224)..(224): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggacgacccctgtcccctcacctgccgctcgtctctggtcnccctccatcaggtagtcggttttctcgtggggctggggtcccggnagcctcccgaaggggacgggctaggaactacgagttggaagtgtcctctacgagttaggtggtacggttacctattaccgacgttcccgtctcctacgaagtaggtcgaacgtaccaacctatactactcgaggtacctaccgtccagactaactccgttacgttttcccgagtaacagttcgtacgttcttcggtaccggtacccgtccgtcgttaacggaaccggtacgggttacgtttttaacgtacgttggtacgtacggtagtaccggtacggtacttaacttagttagtttagtttggtagtttgtttacttacgaaccttaccgtagtacgtcggggtaccgggtcctccggacccggtgggacccgtaagggtactacggtacgtacccgtctaaccgttcctaccgtaccgaccctaaccggcggtacccctaggttccccggtcccgttaccccgccgccccttacccgtcccgaacgtacgtccgacccg

SEQ ID NO: 143123 - DNA, 705 bp, Homo sapiens
  misc_feature: GYAE6OF02JC2PV.46.67.G01.1.454.CMB.1.raw
  modified_base (427)..(427): a, c, t, g, unknown or other
  misc_feature (427)..(427): n is a, c, g, or t
  modified_base (667)..(667): a, c, t, g, unknown or other
  misc_feature (667)..(667): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctggccaaccggtggagacagtgtccaccatccacttggaccgggacaaggtccggaactagttcaccaccttaatttaaagttggtattcaaactatagaccgagggaaccggccccttaagctacctaagtctatgactcgccactcctaggtttcgacgtaaaggtcgggtccccagtcgtacggttcgtagtcggactaggtggtactcggtagggtacaggttatttcaactccttaccgacctntaccgtaagtaactctacgtacgtaaaccgttagtaacgttacgtttcgaacttaaacctttattaccgtttacgtaaaccctaaagaaacgttaaaactttaaccgtaacggttttacgggtttaacccgaaccgtaaacggggtaacctaacgggttaacctaagtaaaaaccgttaaaccgtaacgttaacgtacgggtcttacggactaacctaagttcttaacgtccgtttaccncgttttacccaccccgttaccgacttaccgtgtaaccc

SEQ ID NO: 143124 - DNA, 641 bp, Homo sapiens
  misc_feature: GYAE6OF02I8K5M.46.67.G01.1.454.CMB.1.raw
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (588)..(588): a, c, t, g, unknown or other
  misc_feature (588)..(588): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcaaccgtgganacngtgtcacatcacttgccgggactaaggtcggaacattcgactaccttaattttaaagtcggtatacgaactatacgaaccgagggaccggcccctaagcctacctaatctatcgctgacctactccgtagtttcgacgtaacgggttcgggtcccagtcggtacggttctaggtcgacagggtggacttcggtagggactaggttacttacctacctactacctacgtactaccgtagttaactgtacgacgtaacggtacgtaagttacgtttacgtaacttaactttaacgttacttacgtaactaaacgtaacgttaatttaactacgttacggtttacggaacctaacgggtacaacggttactaaacgttaaataaaccgtatagtacncgtacgactaacgtcgtctctacttctacttccgtacctctactactcgtaac

SEQ ID NO: 143125 - DNA, 907 bp, Homo sapiens
  misc_feature: GYAE6OF02F9VM0.46.67.G01.1.454.CMB.1.raw
  modified_base (152)..(152): a, c, t, g, unknown or other
  misc_feature (152)..(152): n is a, c, g, or t
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttggagaccctgtccctnacctgcgctgtctctggtcncctccatcagttagttggttttccttcgtggggctggggtcccggcagtcctcccgagggggaacgggtctaggaatacagttggaagtgtctctacagtaggtcggtacggtttaccttaagttaccgtacggttcccgttctaccgtacgaaggtacggttccgacgttacccaacctagtttaccgttccgttacgtacgggaaccctaccgttacccggaagtaacctaaaacgttccgtttaaccggttttttccccggaaaggtaaagttagtacggttacgtttcgtacgggttacccggacccgtcccgtacgtacgggaaccgttaccgggggttttacctttttaaacttccggtacgggtcggaccgggaacggtaacgggtacccggttagttaagttttacgttaaggttttaaggtttttggggttaacggttttacggtttttaacgtttaccggttaaacccgttaacccgttaggtaaccggttaccgggggtaccggggtcccgtacccggtaccccggggtcgggtaccggtaacgggttaaccgttacgggttccggtacccgttacccgttcccgtttacccgttaccgtaccccttacccggtaacccggtaacccgggtcccgttaaccggttcccggtttacccccgttcccccggttaccgggtacccccttaccccgttaacccgttaccgaaccggtccttaccccgg

SEQ ID NO: 143126 - DNA, 914 bp, Homo sapiens
  misc_feature: GYAE6OF02H2GTQ.46.67.G01.1.454.CMB.1.raw
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttgggggacctcctgtgcaagaacatgaagcacctgtggtttgtcctcctggctggtggcagctccagatgggtcctgtccctggtgcactgcaggacgtccggcccacgactggtagacggccttcgggacgaccctgtcccctcacctgcgtctgtctcgnggtcnccctcatcgagttgttgtttcttcgtggggctgggccgacgccaccgagggaacgggtctaggaaatcgtagttaggagtagtcctctacagttaggtggtacgtttccgtaacgttagtaccggttccgttctaccgttacgaagtacggtctaacggtaccaccgtaagttacctcgtcccgtacggtaacctaccgtcctaaggtaacctaacgtttaccgttaaccgttttttaaccccgaaggttaaagttacggttaacggtttaccggtttaccgttacgggtaccccggttaaccccgggtaccccgtcggttaaaccggggtacccgtttaaccggggggtttaaccttttttaaacggttacccggtttaggttaccggtaaccgggtaaacgttaaccggggtacccggttactttaaccggttttaagtttaacggggttttaaccgttttttaggggtaaggtttttaccggtttttaacgtttaaaccgtaaccccgtttaaaccggtaaagttaccccggggttaaccggggtacccggggttacccggtacccccggttaacccggggttacccggggtaaccggtaacggggttaaccgttcccggtttaaccgggttacccccggttaaccggtttccccggtttaaccgttcccccgtaaccgttaaaccccccgg

SEQ ID NO: 143127 - DNA, 625 bp, Homo sapiens
  misc_feature: GYAE6OF02IP01J.46.67.G01.1.454.CMB.1.raw
  modified_base (256)..(256): a, c, t, g, unknown or other
  misc_feature (256)..(256): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (527)..(527): a, c, t, g, unknown or other
  misc_feature (527)..(527): n is a, c, g, or t
tcagactagcagtacacgaccggtgctcgatttagagtatacatattgggtttgtcctcctgctgggtggcagctcccagatgggtcctgtcccctggtgcaactgcaggagtcgggccccacgactggtgaggccttcggagacccctgtccctcacctgcgctgtctctggtgcctccatcagtagtggtttcttctggggctgggtccggcagctcccaggggaacgggctggaatacgattgggaagtgtcnctcagtaggtggtaggttcctattacagtccgtctctcaagagtcgagtcaccatatctacgtggacacgtccagcaatctagtttccngaanatgacttctgcgaccgtcgctgacgtcgggtactttatactgtgcgagacgacgctaagttatgttatttggagttgttatttacgactacccgtagtaactaccgggacggggtccgtaccgtacccggtcggggacctagggaacttcgacggttccgacccgttcgtccgttacnccctaccaacccggaacggtaccccgaacgttccggttaccccgtttccccggtacgtaccccgtaccccgtcccgtacccgaacgtaccggtacccg

SEQ ID NO: 143128 - DNA, 663 bp, Homo sapiens
  misc_feature: GYAE6OF02HPHVC.46.67.G01.1.454.CMB.1.raw
  modified_base (357)..(357): a, c, t, g, unknown or other
  misc_feature (357)..(357): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtcccctcacctgcgctgtctctggtcgcctccatcagttagttggttttcttcgtggggcttggggtcccggcagtccgtaccccgaggggaacggggtcgtaggaatacgtagttggaagttgtctctcatagtggtacggttcctattacgagtccgtctcctcaagngtcgagtcacctatactcttcgtcggacaccgtccacgacctaactccgttaacgtttttcccctagaaacgtagttgtacgtttcttcggtacggtcccgtcccgcgtacggacgtacggggttcttttaacttcgtgttggcgaggacgtacggtcttaagtttattagttagttttggtagtttggtttactttccgacctaccgagtcgtaccgggtaccggggtcctacccggtcccggtcgggaccggagggtaactcgtcggtaccgtaccggttcctaccgttaccgtccctacccgg

SEQ ID NO: 143129 - DNA, 845 bp, Homo sapiens
  misc_feature: GYAE6OF02HKM41.46.67.G01.1.454.CMB.1.raw
  modified_base (279)..(279): a, c, t, g, unknown or other
  misc_feature (279)..(279): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtcgggccctacgactggtgacggtcccttcggacgaccctgtccctcacctgcgcttgtctctggtctcccgtctatccgtagttacggttcgttttacttcggtgggggtccgttcggggtcccggngacggtcccgtacccggaagggggtacggggtccgttagggaacttaccgtagtttacgggtaacgttgtaccttcgtacaagttaggttacgggtacggttttaccttaagtttaccgacggttccgttcgtaccttacgaaacgtacggttaccggacgttacccgaactactttaactcccgttacgtaccgggtaacctacccggttaaccgacgttaacccgtaaacttccgttaaccggttttacccaaggtacgtaacgttggttacgtttcgtacggtaccgccggtaccgattaccggtacggttaccggttacttttaagtaccggtggtaggtaccggtaagtacggtaccgtatttaccggttaagtttggttaacgtttttaggtacggttttaggtttacctacgttacccgaacgtttcgtaacgggtcccgggtacgggttcccgtacccggggtacccggtacggggtaaccggaacggtttaacccgtaccgggttaccgttacccgtacccgttaccccggttttcacccggttacccttacccggg

SEQ ID NO: 143130 - DNA, 926 bp, Homo sapiens
  misc_feature: GYAE6OF02I4JF3.46.67.G01.1.454.CMB.1.raw
  modified_base (135)..(135): a, c, t, g, unknown or other
  misc_feature (135)..(135): n is a, c, g, or t
  modified_base (146)..(146): a, c, t, g, unknown or other
  misc_feature (146)..(146): n is a, c, g, or t
  modified_base (162)..(162): a, c, t, g, unknown or other
  misc_feature (162)..(162): n is a, c, g, or t
tcagactagcagtacacgaccggtgctcgatttagagtatacatattgggtttgtcctcctgctggtggcagctccagatggtcctgtccctggtgcaactgcaggagtcggcccagctggtgaggccttggacnccctgtccctnaccgtgcgctgtcctntggtcgcctcatctagtagttggttctcgtgggtctcgggtccgcacggtcctcccggaaggggtaacgggcctaggaaactcgagttgggaactgtcctacgtcagtaggtggtacggttacctagttaacgtcggtccgttctcgtacgaaagttcgtcgtacgtctaccgtatctcgtcgtaggtacctacgtacctacgtacgtaacttcgtaaccggtttttaccccaggtaaaacgtccgtttaggtacgggttaaccttttgggaaaccgtcccgggtaccgttccggtaacggttaaacccggaccgggttttacggttttacgttaaaccgttagggttccggaacggtaacggtaaccgttaacccgggtaccttttaaacgtttaacggttaaggttttaccgggttttaggttaacccggttaggttttaaccgttaaccgtaacgggttacccctttaggaaccgttaccgggggtaaccgggttcccgttaacccgggtaccccgggttaccggggttaccggtaaccgggtaaacggtttccggttaacggttacccggttaaccgggttccccttacgggtttaaccccggcccctttaaacccgggaaccccgggttaacccgggggtccccccttaggggtttaaacccccgttccccggttttacccccccgggaacccggtttccccggtaaacccccgtttcccccgggttaaacccgttacggtaacccccgttaccccggg

SEQ ID NO: 143131 - DNA, 625 bp, Homo sapiens
  misc_feature: GYAE6OF02JDGDZ.46.67.G01.1.454.CMB.1.raw
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (483)..(483): a, c, t, g, unknown or other
  misc_feature (483)..(483): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctaccatcagtagtggtttcttctggggctgggtccgcagctcccgagggacgggctggaatacgagtttcgggaagtcgtacttcctctagttaggtggaggttcctattaccagtccgtctctacaagtacgtcgagtcacatatctcnggacacgtcagcaatntacgttttcccngaagntgagttctgtcgaccgccgctagacgacgggttcgtttactacgttcggtagtccgagtacggtacgtataagtttacgtagttagtttttcggaggtttagttacgttccgaactacccgtaagntaccgggaccggggcctaccggacccgtcgggacgtagggtactacgtcggtaccaccgttcgtccttacgccttaccaccgtacggccctaagtccggttcctccccgtcgccctacccgttccctaccgagccgtacccg

SEQ ID NO: 143132 - DNA, 640 bp, Homo sapiens
  misc_feature: GYAE6OF02JW8QY.46.67.G01.1.454.CMB.1.raw
  modified_base (135)..(135): a, c, t, g, unknown or other
  misc_feature (135)..(135): n is a, c, g, or t
  modified_base (233)..(233): a, c, t, g, unknown or other
  misc_feature (233)..(233): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttggggagtctcggtcaggacacagcatgggacatgagggtccccgctcagctcctggggctcctgctactctggctcgagtcnccagatgtcgacatcgagctgacccagtctccactcctccctgtctgactaaccggtggagacagtgtcacatcgacttgccggacaagtaccggacngttacgactacttatttaagtggtactacaacataacgaccgacgggaaccggtaccctaagactactaactactactgctgcgactctagttagacgtaacggtcggtaccngtacgtaggttcgaggtggactaggtcgtagtcgtgggtacagtattacgtacttcgcactactacagtactactcgaacgtacgtagtaagtacgtttacaacttacgtttacttacgttacgtaactaactacgttaagtaactacggttacgtttacgtacgtaacgtaacgtaactaacttaaaccgtaacgttaaacgtaacgtaacgtcgtacgtactaccggtaactacgttacgttcgttaccttaacgttcgtacccgttacccgtacttcttaccgtattaccg

SEQ ID NO: 143133 - DNA, 648 bp, Homo sapiens
  misc_feature: GYAE6OF02IQ29M.46.67.G01.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcggagcctcgaccccagtcctccatccctcctgtctgccacggtgganacngtcaccacatcacgttcgccggacacggtacgatnttacgactacttaattaaagttggtatacaacgatacgaaccgacggaccgaccctaagtccttactaactactagtcgactcgactacgtcctagttacggaacgtaacgggttcgggtaccctagtcggtacggttcgaggtcgacgtaggtcgattcggaggaactagttacttaccacttcacctactactctatacgtctagacgtaagtagtattacttacgactaacgttacttagttctaactaactaacgttaattacgtagtttaccgttacggtaaccgaacgtaccgtaataacgttaaacttaaaagtaacccgttaagtgtacgtactacgtaccgtaacttacgttctaacgttccttaaccgtaccttccggtaccctacttacttaccgtagtaccg

SEQ ID NO: 143134 - DNA, 769 bp, Homo sapiens
  misc_feature: GYAE6OF02HJHSQ.46.67.G01.1.454.CMB.1.raw
  modified_base (193)..(193): a, c, t, g, unknown or other
  misc_feature (193)..(193): n is a, c, g, or t
  modified_base (246)..(246): a, c, t, g, unknown or other
  misc_feature (246)..(246): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtcgggcccacgactggtgaggccttcggagaccctgtccctnacctgcgctgtctctgtgcctcatcagtagtgttctgtggggctgggtccggnagcctacccgagggtaacggggctaggaagtacgtaagttcggaaagtggtacctcgtcaagtagtgggtaggttcttatacgtacgtctctctcgaacgagtacgagtcgaactatatctacgtacggtacctacgtaccgagtactaaacgttacgtaacgtttttccccgtaaggtaaacgtagttcggtaaagtttccgttagggttaccgtacccggtaccgacgttaccggtaaacggtaccggggtttaccggttttaaatttacccggttaggttacggtacggtaacggtaacgggtaaccggtacgttaaacgtttaagttcggttttaaagttttttccggggtaaggttttacggtttaacggttttaccgaaccgttacccgttaacggtacggttaccgggacgggggttccctaccccgggtaacccggtcgggttacccggaaagggtaacgttaaccgttaccggtacggtacccggttacgttacccgttcgtaccctaacccgg

SEQ ID NO: 143135 - DNA, 774 bp, Homo sapiens
  misc_feature: GYAE6OF02FM3NL.46.67.G01.1.454.CMB.1.raw
  modified_base (423)..(423): a, c, t, g, unknown or other
  misc_feature (423)..(423): n is a, c, g, or t
tcagactagcagtacacgaccggtgctcgatttagagtatacatattgggtttgtcctcctgctggtggcagctcccagatgggtcctgtccctggtgcaactgcaggagtcggcccagactggtgaggccttcggagaccctgtcccctcacctgcgctgtctcgtggtcgcctcatacaggttagttcggtttacttcggtgggcgttgggcccgacacgcctaccggaaggggaaggcgtaggtaactacgtagtacgggaattctactcgtacagtaggtggtacggtttctaacttacgcgttccgtctcgtaacaaggtacgtcgacgtaccaactagtactccgtacgtacggactaccgtacctagactaagtccttacgttaccagaagtcgtcggttattcgtgtaccggacnccgtagtaacgacggttcgggttactttatcgttaggacgacggtagacgaggtacttaagttacgtaggtttagtttacgggtagttacgtttacgttaacgtaaccgtaccgtagtaacgtccgggtacgggtaccgtaccccggtaccgggtcggtaacggttaaacgggtaaccgttacgggttaccggtaacccgttccggtttacccgttaacccggttaccctacccgtaacccgggaaaccggtaaccggtacccttaccggtttccccggttaacccccgtttccccggaccgtttaccccgtacccccgttaacccgaacgtaacccggtactaaccccgg

SEQ ID NO: 143136 - DNA, 688 bp, Homo sapiens
  misc_feature: GYAE6OF02H9Z5U.46.67.G01.1.454.CMB.1.raw
  modified_base (184)..(184): a, c, t, g, unknown or other
  misc_feature (184)..(184): n is a, c, g, or t
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
  modified_base (571)..(571): a, c, t, g, unknown or other
  misc_feature (571)..(571): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgacctgggtgaggtccttcggganaccccttgtccctcacctggcgctgtctctggncctcatcagtagttcggtttctcgtggggctggggtccgancgtccgtacccgaggggaacggggtctaggaactactagttagggtaagttgtccgtcttacgtaagttagggtaggttacggttaccttaagttacaacggtttccgtacttacgtacctaaaggcgtacggaagtccaacctaagttactctcgtacggtaccacgtccagtactaactcgttaagttttcccaaggtacacttgtagtttctaggtcgacccgcgtcgtagtaaccgcggggttaactttacgttaacgtcgtacgtcgaacgtacggtacggtacttagtagtttagtagtttttaggngttagttacttcgaacctaccgagtacgtacggtacgggtctaccggtaccggtcgggtacaacgggttaactcggacggttacccacggtttccgtacgttacgcccgttaacccg

SEQ ID NO: 143137 - DNA, 631 bp, Homo sapiens
  misc_feature: GYAE6OF02IB1JK.46.67.G01.1.454.CMB.1.raw
  modified_base (97)..(97): a, c, t, g, unknown or other
  misc_feature (97)..(97): n is a, c, g, or t
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (617)..(617): a, c, t, g, unknown or other
  misc_feature (617)..(617): n is a, c, g, or t
tcagactagcagtacacgaccggtgctcgatttagagtatacatattgggtttggggagtctcggtcaggacacagcatggacatgagggtccccgntcagctccgtggggctcctgctactctggctcgaggtgccagatgtgactatcgagctcgacccagtcctccatccctccctgtctgccgaacggtggganacgagtcgtacaccatcgacgttcggccgganaacggtcggaactagttcgacctaacttaagttaattggtacacaatagtacgacgacgggaccgaccctaagctactagtactatacgactgctatcgtagttacgacgtaaggtaccggtccagtcgtagtcagtgagtgtggacgtacgtaggtacacgtcttacactacgtctactagtactaggtactcgtacgtacgaacgtacgtattagttacgtaacttacgtttactacgttagtaacaagttagtaacgttataacgtttggttaaccgacggtaacgtacgaacgttaacttaaacgaaacgttaacgacgttgtacgtaccgtacgtacgtaactacgtcttaccgttcctacgtacgttccctccgtaacctntaccgtagttaccg

SEQ ID NO: 143138 - DNA, 660 bp, Homo sapiens
  misc_feature: GYAE6OF02IC6P8.46.67.G01.1.454.CMB.1.raw
  modified_base (369)..(369): a, c, t, g, unknown or other
  misc_feature (369)..(369): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctcggacccagtctccatccctccctgtctgaccgacggtggagacagtcgtcaccatctacgtcggaccggcaaggtacggaactagtcgaactaccttaattaagttggtactacaacatacgaccggacgggaccgccctaagcttacctaattctatcgtactagtacgtaccgtagttcgacgtaaggtccggtaccagtcgtaggttacnggtgctaggtcgtagtcggtaggtactgtacttccactcactaccgatacgtaagtactctacgacgtaaggtacgtaagtttcgttaactaccttaaacttcgttagtaccgtaactaaagttaacgttaacttaacgtagttcgttaaccgggaccgaaaggtacctaaacgtaacgttaattaaaacgttaaccgtacgtggtacgtctaccgtaacctagtccttacgttccttccttaaccgttcttacccccgtccgttacttacgtaccttacggtaccttcgg

SEQ ID NO: 143139 - DNA, 825 bp, Homo sapiens
  misc_feature: GYAE6OF02HK4LB.46.67.G01.1.454.CMB.1.raw
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctcgcgtaaccggnggganacgtagtgtcacganctacgttcggccgggacaaggtccggaactacgttagtacctaaccttaatttaaagttcggtacttacaaactaacgtaacgtaccgaacgggtacccggaaccccgttaacgccttaacctaacgtaccttaagacgtaccgtacgcctactaccgtaggttttagaccgtaaagggtcgggttaccctaagtacggtaacggttacgacgggtggtacgaagggttacggtactaccggttacgggaactaacggtactttaccgaacttacccgtaacctaacgtaaccgttaacgtaaacgttaacttcccgtagtaaccgaaacgggttaagtaaaacgtttaagttttaccgggtaaactttaaacgttttaacgttaaacgttaaccgtaccgttaaacgtaaaccgttaaatttaaacgttaacgtttaacggtttaacccggtaacgtaaacggggtaaactaacgttaaacctaaaccgttaaaaacgttaaaaaccggtcgttaaggttaccgtacgttaacgtaaccgaaactaccgttaccgttaacggtttaacctaccgttacgttcccgtaacccttaccgacctttacgtacgtaacg

SEQ ID NO: 143140 - DNA, 833 bp, Homo sapiens
  misc_feature: GYAE6OF02GI6AN.46.67.G01.1.454.CMB.1.raw
tcagactagcagtacacgaccggtgctcgatttagagtatacatattgggtttgtcctcctgctggtggcagctcccagatgggtcctgtccctggtgcaactgcgaggagtcgggcccacgactggtgaggccttcggagaccctcgtccctcacctgccgctgtctctggtcgcctccatcgagtagttggttttcttcggtggggtcgtcggggtccggcgagcctcccgaggggacgggctaggaatacgtagttggaagttcgtcgtctctagtaggtggtacgttctattactgtccttcgtctacgaagtacgtcgacgtccaaccgtattacttccgtacggaccggtacctaccggtaccgaacgactaaaccgttccgttaccgtttttacccgaggtaaagtagtagttacgttacgtagtccggacccgtccggtacgtacggtaccggtacgggttaccgttttaacgtttacgttcgtacggacggtacggacggtacggtttacttaagttttaggttacgtttagttttagggttgggttaacggttttacgttaaccgtaaccctaccgttaagggtaacggtccgggggtaaccggggtcccgtacccgggtacccggtccgggggaaccgtaaggggttaacccttacggggtcggttaacccgtaacccggttccgtttaaccgtcccggtacccctaacccggtaacccgggtacccgggttaacccgtccgggtttaccccggttccccttacccccggttccggtaaccccttccccgtacccggtacccggaccggaccgttaccccgg

SEQ ID NO: 143141 - DNA, 844 bp, Homo sapiens
  misc_feature: GYAE6OF02HWS88.46.67.G01.1.454.CMB.1.raw
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
tcagactagcagtacacgaccggtgctcgatttagagtatacatattgggtttgggggacctcctgtgcaagaacatgaagcacctgtggtttgtccctcctgctggtggcagcctcccagagtcgggtcctcgtccctgggtgacaactgcgagggacggtccgggcccacggtacgtgggtaggacggtcccgttcgggaacgtccctcggtcccctacaccgttggcgtccgttcggtccttcgtgggtctccctccagtcgtaggttaggtttcggttttcctcggggtggggtcgttcggggtcccgagccgtccgtacccgggagggggtaagggtcctaaggtaactacgtagtaggtacgtcgtctctagtagtaggtggtacgttacctaattacgcgttccgtccntaccgaagcgtacgagtaccaacgtntactctcgtacgacctacgctagactacgttcgttactttcgagaatgtcgtagttcgtacggtcgaacccgtcgtcggtaacggtccggtaacgggtttctttaaacggttcgtacgggttaccggtacgaaacgggtaccgtaaccggttatttaaacggttttgtaacgggtttttacggttttacgggttagggttacggtttttaaccctaccggttaacccgaaacgtttaacggggtacccgtaccgggggacccggggtttacccggtaacccgggtcccggggtttacgggaccgggttaaaacggggtttaacccgacggttttccggggaacccccttaaccggttacccgttttacccccggtaaccgggttcccccgaaacccccgggg

SEQ ID NO: 143142 - DNA, 749 bp, Homo sapiens
  misc_feature: GYAE6OF02I7KAG.46.67.G01.1.454.CMB.1.raw
tcagactagcagtacacgaccggtgctcgatttagagtatacatattgggtttgggggacctcctgtgcaagaacatgaagcacctgtggtttgtcctctgctggtggcagctcccagatgggtcctgtccctggtgcaactgcaggagtcgggcccacgactgggtgaggccttcggagaccctgtccctcacctgccgctgtctctggtcgcctcatcagttagtggtttcttgtggggctcgggtcgcagccgtccgaggggaagggctggaatcagttggaacgtgtctctcatagtgggtacggttctagttaactacggtccgttactctacgtaagtacggtcgtaagtccacgtatatcctcgtaggaactccggtcagtctaatctacgtttccagatacgttacgtgtttactggtaccgtacccggtaccgtcgtccggtaaccggttaccggggttacgttttaacctttaacggtcggttaacgacggtaaggaccgtaacggttaccgttaattttaacggttggttttaacgttttacggggtttagttttacggttttactttaaccgggtaacccttaacccgttaaagggaccgttaccggggtacccggggtccgtttaacccgggaccccgggttagggggtaacccggtaacgggaaaccgtttacccgggtacggtcccggttaaccgttcccgttttaaccgggtacctaccccgttaaccccggg

SEQ ID NO: 143143 - DNA, 583 bp, Homo sapiens
  misc_feature: GYAE6OF02GNZ4F.46.67.G01.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacgtgganacagtgtcaccatcacttgccggnaagtcggaacattgacacctatttaattgtatcaacatagaccaggacgccctagctctaatctatgctgcatcctagtttgactaaaggtcgggtacccagtcgtaggttcagtggcagtgatcgtaggacagtattcgactcactacgtatcgaagtatcgtgactacgtagtaagttatttagtactaacgttattacgttagtactaacgtagtaattaactaagtttacgttttaccggactaagggacctaacgtaacgttaaactaaagttaaacgaacttagtacgtacgttacgaccgtactacttccgtacgttcgttacctacgtttcccgtcccgtacctcttacccgttagtaaccg

SEQ ID NO: 143144 - DNA, 1066 bp, Homo sapiens
  misc_feature: GYAE6OF02HWY0X.46.67.G01.1.454.CMB.1.raw
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacagtcgagctgacccagtctccactccctccctgtctgaccgaaccggtgggagacagtcgtaccacctatccacgttcggcccgggtanaacggtacggaactacgttacgaacctaccttaattttaaaacgttggttaacttaccgaaactaacgttaacggaaccggaacggggtaccccggtaacccccgttaaaggtcccttaacccgtttaaattaccgttacgttacggtaccttaccggtacctaaccgttaccgttaacggttttacggaaccggtaaaaccggggttccggggttaacccctaaggttacccgggttaacgggtttaccgtaacgggttacgggaacgtacgggttacggtaaccgttacgggtacggtaacggtaacgtttacgtttacctaacccgttaccgtaacccgtaaaccgtacgtaccggtaaagtttaaccgtacgttacggtaaaccggttaaacccgggttaagttaaacggtttacgttttaaacgtaacccgtttaaaccgttttaacgtttaacccggttaaaccggttaaccgttaaaaccggttaaacgtttaaaacgggtttttaaacccaaccgggttttttaaaccggggttttaaacccgggaaaccgggttaaaacccgggttaaacccgttaaaacccgggttaaaacccttttaaaaacccggttaaaaaaccggtttaaacccggtaaacgggttttaaccgggttaccgggttaaaccgttacccggtaaaccccgtaaaacccggttttccgtttaaacccgttttacccggtttaacccgtttaaccgtttacccccgggttttaaccccgttacccccccgggttttaaacccttaaaccgggttttcccgttaaacccggttttaaacccgg

SEQ ID NO: 143145 - DNA, 656 bp, Homo sapiens
  misc_feature: GYAE6OF02F67HT.46.67.G01.1.454.CMB.1.raw
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccgagggaagggctggaatacattggaagtgtctctcatagtggaggttcctattacagtccgtctctcaagagtcgagtcaccatatctcnggacacgtcacgcaatctagttttcccaganagtgtagttctgtcgaccgccgctagacgacgggttcgtttattactgtgcgagagtacggacttattattgtagtttttaggtagttggtttactttcgtacctaccgttagtacgtcgggaccggggtccgtcccgtaccccggtcgggtaccggaggggtaacgtaccggttacgggttaccgacccgttccgttacccgttacggaccccttacccgaacccggttaaccggggaccccttacggttcccggttccccgtttccccgtcggtcccctacccccttaccccggtacctacggaccgttaaccccg

SEQ ID NO: 143146 - DNA, 715 bp, Homo sapiens
  misc_feature: GYAE6OF02HTCP0.46.67.G01.1.454.CMB.1.raw
  modified_base (173)..(173): a, c, t, g, unknown or other
  misc_feature (173)..(173): n is a, c, g, or t
  modified_base (290)..(290): a, c, t, g, unknown or other
  misc_feature (290)..(290): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggacgaccctgtccctcacctgcgctgtctctggtncctccatcagttagttcggtttctcgtggggcgtcgggtccggcacgtcctccgaggggaaggggctaggatacagttggaagttgtctcactagtaggtggtacggttctattacncgtctctctacagagtcgagtcaccatactctcgtacggactacgtccgagtcactactacgttttccctagaagattaggtacgttcgtaggtcgaccgtcctcgtacggacgtaccggggtattttacgttcgtaggtcggtaggagacggtacggtacgttattagttagtttaggttttcggtaggtttacggtttacttcgttaaccgtacccgtcggttaaccgttacggggacgggtcccgtacgggtaccccgggtcggggtaccggaacggggtattaccgggtcggttacccgtaccgtccgttacccgttactccccgttacccgaacccggtacccggtccctacggttcccgtaccccgtttccccgtcggtaccctcccccgttaccgacccgttaacggaccgtacccgg

SEQ ID NO: 143147 - DNA, 775 bp, Homo sapiens
  misc_feature: GYAE6OF02JM3VX.46.67.G01.1.454.CMB.1.raw
  modified_base (213)..(213): a, c, t, g, unknown or other
  misc_feature (213)..(213): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttggggagtctcggtcaggacacagcatggacatgaggtccccgctcagctcctggggctcctgctactctggctccgaggtgccagatgtgacatcgagctgacccagtctccatcctcctgtctgcaaccgtggagacagtgtcaccatcacttgccggnaagtcgaacattgacacctatttaactgtatacgaactatacgaccagggaccggaccctaagctacctaatcctatcgctgcaatcctagtttcgacgaacgtcgggtcccaagttccggaaggtttccaagttcggactaggtacggatcgtggggactaggntttaccgacgttcgtaccactactacgtacgtaacgtctagggtcctaaacggtcgtaaacggttacgttttacggtaacctttaaaccgttttaacgttttaaccgttaacgtttaaccgtaaaccgtaacgttaaaacgtttaaacccgtttaaacgtttcgggtttttaaccgggaaccgggttaaaccgggttaaaccggaaaccccggtttaaacttaaaccgttaaaaacccgttttaaaaaccggtaaacccgtttacggggttaccggttaccgttacggtacccaacccgttaaacgtttacgtaaccccgggttttaccgttaccttaacccggtttcccgtttaacccccgtacccgttaaccgttaccgttaccggttaaacccg

SEQ ID NO: 143148 - DNA, 794 bp, Homo sapiens
  misc_feature: GYAE6OF02HTSQN.46.67.G01.1.454.CMB.1.raw
  modified_base (773)..(773): a, c, t, g, unknown or other
  misc_feature (773)..(773): n is a, c, g, or t
tcagactagcagtacacgaccggtgctcgatttagagtatacatattgggtttggggagtctcggtcaggacacagcatggacatgagggtccccgctcagctcctggggctcctgctactctgctccgaggtgaccagatgtgactatcgagtctacgacccagtcctccacttccctcccgtagtcgtgaccgtaaccggtgggacgacgtagtccgtaccacctatctacggttcggacccgggtataaggacgaactagttacaacctaacctttaaagtttaagttgtactaacaactacgtaacggaccggaacgggaccgtaccccgtataccttaccgtaattccttagtcgaccgttcgtaccgtacgttaccgttaggtttaacggaaccggtaacggggttaccggggtaacctacggttacggttacggttaccgaggtacggtacgtagggtacgtagtcggtacggaactacggttctttaccgacctccgtaacctactacgttacgtaagtacgtctaacgtacgttaaacgtacggttaaagttacgtttaaccgaaccttttaaacgttacttacgttaacgtaaacttaaagttaaacgttaaacttaacgtttaacggtttcgttaaccggaccggtaaacggtaaacaccggtaaacttaaaaccggtaaaagttaaacgacgtttacacgggtactacgtaccgtacggttactcccggttaattacctaccgttcgtaccccttaccggntttaacggtaccttagtaccg

SEQ ID NO: 143149 - DNA, 828 bp, Homo sapiens
  misc_feature: GYAE6OF02HS142.46.67.G01.1.454.CMB.1.raw
  modified_base (351)..(351): a, c, t, g, unknown or other
  misc_feature (351)..(351): n is a, c, g, or t
  modified_base (411)..(411): a, c, t, g, unknown or other
  misc_feature (411)..(411): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccacgcgtggtgacggtccttacggacgacccttgtacccctcaccgtgcgctgtctcgtggtcgtcctaccgatcgagttaggttcggttttccttcggtgggggtccgttgggggtccccggactacggcccgtacccggaaggggggtaacgggtcgttaggtaaatacgtagttggggaacgttgtcccttntacgtaaggttagggtcggtacggtttcttaacgttaaccgcggttcccgtcttcgtaanaacggtacgtaccgtacgtacccaactagttactcctacggtacggacccctacggtacctaagaccgtactttaacccgtttactttacccgaaggtaacgtaggttactacggtttcgtacggtcccggaacccgtccgtacgttacgggtaaccgggttacgggtttaccgttttaacgtttccgggtggtaacgaccggggtaaagtacgggtaccttaagttgtttaacggttcgttttaggtttacggtaggtttccgtttacttaacgtaccgttaacgtgggtaacgtaccggggtcccggggtactaccccgggggtcccggtaagggtcccggtaaggttaacccgttcggttacccggggtaaccctcccgttttaacccggtcccttaccggaccccgtaaccgg

SEQ ID NO: 143150 - DNA, 711 bp, Homo sapiens
  misc_feature: GYAE6OF02HRHMX.46.67.G01.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcacttgccggnaacgtcggaacnttgacacctatttaaatgtatcgaacagtagacctaaggacgtcccctaagctaccgtaatcttaatcgcgtnacacgttccagttttcgacgtaaagtcggggtaccccagttccggaggttcacggtggaccgtaaggttggtaactcggttacggaacttacgtaatttccgaacttccgtacaccgtaactactaaggttaacttaccgtacgtaacgtaaacggttacgtaaagttacgtttttacgaacgttaacttttaacgtttaacttacggttacaaacgttaacgaaacgtttaacctaaagtttacgttttaccggacgttaaacggggaaccctaacggtaaaccgttaaactaaaacgtttaaaaccgaacgttacgggtacggtaccgttaggaaccgtaacctacgttaccttacggttcctttaactacgttaccgttccccgtacctactttaccggtattaaccg

SEQ ID NO: 143151 - DNA, 653 bp, Homo sapiens
  misc_feature: GYAE6OF02GZ9TG.46.67.G01.1.454.CMB.1.raw
  modified_base (247)..(247): a, c, t, g, unknown or other
  misc_feature (247)..(247): n is a, c, g, or t
  modified_base (276)..(276): a, c, t, g, unknown or other
  misc_feature (276)..(276): n is a, c, g, or t
  modified_base (350)..(350): a, c, t, g, unknown or other
  misc_feature (350)..(350): n is a, c, g, or t
  modified_base (426)..(426): a, c, t, g, unknown or other
  misc_feature (426)..(426): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttctcgtgggctgggtccggnagtcctccgaggggagggctggaatacgngttggaagtgtctctcatagtggaggttccattacgcgtccgtctctcgaagtcgtcgagtccactatatctcnggacacgtccagcaactcgtacttttcccagaagtatgtactttcgtcgttacgccgtccgcgtgacgtcgggttntttaagttcctggttcgacggtgacggacgtattaagttgttcgtttaagtttttagggagtttaacggttttgtttaccgaacccttaccgttaaagtcgtttaccggggacggggttacccgtaccccgggttaaccccgggtgggtaacccggtaaacggtaccgtttacggtaccgttccgtaaccggtttccccttaaccgttaccgtccccgttaacccgg

SEQ ID NO: 143152 - DNA, 625 bp, Homo sapiens
  misc_feature: GYAE6OF02GJ6GC.46.67.G01.1.454.CMB.1.raw
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatcctccctgtctgcaaccggtgggagacagtcgtcaccatcacttcggccggnagtcggaactagttgacacctatttaattgtatcaacatagacaggacgccctaagctactatctatgcngcatccgagtttcgacgtaagtcgggtacctagtacggtacggttnaggtaggcgtaggtggagtcgtagggtacaagtacgtttccacgttacctacgtaaccgtatacgtaaggtactacgtcgaaactacggttacgtaaagttacgttttacggtaacctaacttttacgttacgtacgtacttaaacgaagttaactacttaagtttcggtttaccgacgaacgggtaccaacgaacttaacgaaacgtaaacgtaacgtggtacagtacgactacgtaactcgttaacttcgttactactaccgttaccctactacttcgtacgtac

SEQ ID NO: 143153 - DNA, 620 bp, Homo sapiens
  misc_feature: GYAE6OF02GHBX5.46.67.G01.1.454.CMB.1.raw
  modified_base (165)..(165): a, c, t, g, unknown or other
  misc_feature (165)..(165): n is a, c, g, or t
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtccnccatcctccctgtctgcaaccggtggganacagtgtcaccatcacttggccgggacaaggtcggaactnttcgacctaccttaatttaactggtatacaactatacgaccgacgggaccgcccctaagccttacctaatctatgctcgacacttacctagtttcgacgtaaggtcgggtacccagtccgagttcgagtcggacaggtgactcgtagggactagttacgttaccacgtcctaccacctactacgtagttaactcgtacgacgtaacggtagtaaaggttatttacgaacttaacttattaccttacgtaacaactaagtaacttacgtattacgtttacgaccgtaagacctacgtaactaacgtaaataacgacgtgtacgtactacgacctacgtacgttctgttaccttacgtcttaccgttaccgtacctactcgtagtaac

SEQ ID NO: 143154 - DNA, 779 bp, Homo sapiens
  misc_feature: GYAE6OF02F3KX5.46.67.G01.1.454.CMB.1.raw
  modified_base (223)..(223): a, c, t, g, unknown or other
  misc_feature (223)..(223): n is a, c, g, or t
  modified_base (315)..(315): a, c, t, g, unknown or other
  misc_feature (315)..(315): n is a, c, g, or t
tcagactagcagtacacgaccggtgctcgatttagagtatacatattgggtttgggggacctcctgtgcaagaacatgaagcacctgtggtttgtcctcctgctggtggcagctcccagatcgggtcctggtccctggtgcaactgcaggagtcgggcccacgactggtgaggccttgagaccctgtccctcaccgtgcgcctgtctcgtggcgcctccatcngtagttcggttcttgtgggcttgggtcggcaggcctaccgagggaggggcctggtaactacgtagttggaagttcggtctcgtctagttggnggtacggttcctaagttaacacggttcccgtctaccgtgaacggtagtccgtagtaccaccgtaatcgttcgtactacggaccgtaccgttccgaagaccgtaatacccgtacgtttttaccccctaaggaaacgtacgtacgttacggttcgtagttacggccccggtaccgtaccgtacggtaacggtacccggggtaagttttaccgttaccgttaggttacgaccggtaagtaccgggtaacgtccgttaacgtttagttaccgggttaagttttttccgggaaggttttgtttaaccgggtttaaccgtaaccgtacccggttaacgttaacgtccgggggtacccgggtaggtaccccgttacccgggttacgggtacccgggtaacggtacgttaacggttaccggtacccggttaccggtccttttacccggttaccgaccccggttaaccccggg

SEQ ID NO: 143155 - DNA, 691 bp, Homo sapiens
  misc_feature: GYAE6OF02GVT7W.46.67.G01.1.454.CMB.1.raw
  modified_base (479)..(479): a, c, t, g, unknown or other
  misc_feature (479)..(479): n is a, c, g, or t
tcagactagcagtacacgaccggtgctcgatttagagtatacatattgggtttggggagtctcggtcaggacacagaatggacatggagggtccccgctcgagctcctggggctcctgctactctggctcccgaggtcgccagatgtgacatcgagctgacccagtcctcactcctcctgtctgactaaccgtgggtagactagtcgtccacctatcgaacttcggccgggactaaggtccggaactagttgaacctaccttaatttaaattgggtaactcgaacataagaccgagggaccgtcccctaagtccttacctaattctatgactcgactacgtctagtttcgagtaaggtcgggtccagtccgagtcagtgacgtagtgactcgtggactagttacttccgactcctcacctatacgaagttctcgtaccgctaaggtacgtaagttacgttcactaacgttctacgttanaacctaataacgtaattaaccgtagtttcccggttacgaaaccggttaaccgggtaacctaccgggtaacctaaaacgttaaaacgttaaacccgtaaccgttacggtacggtaacgtcccgaaaccgttaccgtacgtttaccggttccgttacccgttaccttcgttccccgtttaccgaaccgtttagttacccgtagtactttaccgg

SEQ ID NO: 143156 - DNA, 859 bp, Homo sapiens
  misc_feature: GYAE6OF02HUXGM.46.67.G01.1.454.CMB.1.raw
  modified_base (145)..(145): a, c, t, g, unknown or other
  misc_feature (145)..(145): n is a, c, g, or t
  modified_base (171)..(171): a, c, t, g, unknown or other
  misc_feature (171)..(171): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtcgccagatgtnacagtcgagctacgaaccctagtccncctactccctccctgtctcgaccaaccgggtgggagacgnggtcgtccaccacttaccgacgttcggaccgggacaacggtaccgaactagttaccgacctaactttaatttaaagttacgtacgttacaactacgtaccggaaccggaacgggacccggtaaccccgtaaccgtaccgttaccctaaacgttaccttacggttcgtacgtccgtaacaccgttaaccggttacgggttttacggaaccgggttaaaccgggttcgggtaaccctacggttacggtacggtttacggaacgggttcggaacggtacggggtagtacgtaccgggttacggtaacgtatttaccgttaaccgtaccttactaacccgtactaaccgttaacaaacgtttacggtcctacggtaacgtaaacggtacgtaaagtttacgtttaacgtaaaccgtttaacttaactttacggttaaccttaacgtaaacttaaagttaaaccttacgttttacggttaccggttttaccggaaccgggttaacgtaccctaaaccgtaaacgttaaaaccttaaacggttaaactaaacgggtcgtaccggtacttaaccggtaccgtacgttaacctttcgtaacgtttcttaccgttacccgttaccgttaccccgttacgtaacgttccgattaccgg

SEQ ID NO: 143157 - DNA, 800 bp, Homo sapiens
  misc_feature: GYAE6OF02IJ97Q.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtccggcccacgactcggtgaggtccttacggacgaccctcgtccctccacctgcgctcgtctcgtggtcgcctacatcacgttaggttcggtttcttcggtggggtcgtgggtcccgcacgccgtaccggaggggtaacggggtctaacggtaacttacgtagttgggtaacgtttcgtaccgttaccgttacgtaagttacgggttacgggtttaccgttttacccgttaacggtttaacgaccggtttcccgttaccttaccgtaacggtaagttaccgggttccgaaaccggttcccctaacgttacgtttacgttccgttacggtacggaccccgtacgtaccgtaaacgcgtttaactaccgttttaccgtttaaccagtaggttacgttacgttaacgtttcgtaccgtaccgggtaacccgcgtacgtaacggtacgttccgttaagttttacgtcgtaggtcgtacgtaaggtacgttacgtacttagtttagttgggttttaacgtttggtagtttaacgttccgtttaacgaaccgtacgtaccgtaggggtacccggtcgttaaccgtcccgggcggtacggacgtaaccggtactccgtacggtaccttaccgtctaaccgtccgtacccgaaccgg

SEQ ID NO: 143158 - DNA, 739 bp, Homo sapiens
  misc_feature: GYAE6OF02ILWKR.46.67.G01.1.454.CMB.1.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
  modified_base (479)..(479): a, c, t, g, unknown or other
  misc_feature (479)..(479): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggtcccttcggagaccctgtccctcacctgcgctgtctcgtggtcgcctccatcagtagtggtttctcgtggggtctgggtccgnagtcctcccgagggacgggtctaggaatacagttcgggaagttgtctactntacgtgtggtacgttcctatacacgtcctctctacagtacgtgatccactatactctcgtcgacgtactccgagtactatacgttactttacccaggtaacgtattgtacgtttcgtacgtccggaccgtccgactcggaccggtcgggtttacgtttactacgtggtacggcggtagaccggtagtcttagtagttacgttttagtttaggnggttttacggtttacgttaccgaccgttaccgtagtacggtacccggggtacgggtcctacccgggtcccggtacgggtaccgtaacgggttacttaaccgggtaccgttaccgtacccggtttacctttacccgtaccgtccccgtaacccgtaacccggtacccggtacccttacccggttaccccgggttcccccgtttcccggacccggttaccccttacccccggtaccccgtaacgtaccgtcccgttacccgg

SEQ ID NO: 143159 - DNA, 737 bp, Homo sapiens
  misc_feature: GYAE6OF02HB99V.46.67.G01.1.454.CMB.1.raw
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagtcctcccgagggaagggctaggaatacagttggaagttgtctctcagtaggtggtaggttctaattacagttccgtctcgtnaagngtcgagtcacatatctcgtggacctacgtaccagtactaacttccgtacgttttcccaggtaaacgtacgttagtacggttctagggtcgtacccgccgtcgtacggaccgtacggggtttacttttaacgttacgtcggttacgaccggtaaggtacggacgggttacctttaaagtttacttaggttacgtttttagggtaggtttcggtttagtttaccgtaaacgttacccgtaaggtacgtaccggggtacggggtcctacccggacccggtcggggaccgtaacggggtaacttaccggtcgttacccgtaccggttcccgttacctttaaccgccccgtaaccgtaacccggtaaccgggtccctaccggttcccggttccccctttaccccgtacggaccccttcccgtaccccttaccgaagcccgtacccg

SEQ ID NO: 143160 - DNA, 845 bp, Homo sapiens
  misc_feature: GYAE6OF02GXAPA.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatcgggtcctgtcctggtgcaactgcaggagtcgggcccacgacgtggtgacggtccgttcggacgtacccttgtcccctctaccgtgcgtcttcgtcctcgtcggtccgtcctactattcgtagttacggttcgtttcgttcggtcggggtcgttcggggtccgacgcgtccgtaccggtagggggacgggtctaaggtaacttacgtagtttagggtaacgttcgttctaccgtacgtaacggttaggttacgggttaaccgtttaccttaacgttaaccgtcggttcccgttaccgttacgtacgtaaacggtcggtaacgtaaccgtacctaaaccgtagttaacctcggttaacggtacggaacccgtaccggtacctaacggtaccttaaacgttccgtttaaacccgtttcgaaggtaaacgttgttaaccggttcgttacgtccgggaacccgttaaccccggctacggtaaacggtaccgggttacggtttacttttaaacgtcgggttggtaacggtaccggtaagggtaccgtaaccgtttattttaagttccggtttagttttaggggtttggtaaacgttttgtttaacccgtcgtaacccttaacggtgtacccgggtaccggggtactaccgtccccgggtcggaacgggtaacgtagtacttcggtaccgttcccggtaccgttccaccgggtacctacccggtaaccg

SEQ ID NO: 143161 - DNA, 633 bp, Homo sapiens
  misc_feature: GYAE6OF02JEEHM.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggttcttcgtgggctgggtccgcagcctcccgagggaagggctggaatcgattggaagtgtctctcatagtggtaggttcctatacgtagtccgtctctcaagagtcgagtcacccaatatctcgtggacacgtccagcatctagttttccctagaacgatgtattctagttcgccgtcgctcgaaccgtcggttcgtttactacgtgtgcgaagtcggacggtcttagttagtgttattttgggtagttggtttacttaccgactaccgtagcgtcgggacgggtcgtaccggcccggtacggggcgaagggacgtacgtcgtaccgtacgtccttcgttaaccgcccgttaccaacccggtaccgggtacccctacggttcccggtccccgtttacccccgtcggtaccctacccccttcccgtacccgtaccgacctaccccgg

SEQ ID NO: 143162 - DNA, 769 bp, Homo sapiens
  misc_feature: GYAE6OF02F4J2I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgccaaccgtgggagtacagtgtcaccatcaacttggaccgggacaacggtacggaacctagttcgaactaccttaagttttaaaattggtaacttacaaacgtatagtaaccgagggtaaccggaccccgttaaagccttacctaacttacgtactgacctcggactacttctaacggttgaaccgtaaaggtcgggtacccagttcgtaaggttcgaagttcgcgacggtgaattcggacggacaaggttctttaccatcgttacaacctataacgtagtaactcgtacgaccgtaacgtagttaaacggttatttaccggtacttaaaccgttttacgtttaaacgttacgttaacctaaacgtaaacgttaaaacttaaaccgttttaaacggtttaccggtttttacggaaacccgggtaaacgggtaacctaaaaccggttaaccgttaaaacttaaaaacggtttaaaccgtaaaccggttagttaccgttaacgtccgtaaccgtaaccgtaaccgttacgttacgttaccttaccgttaacttcccgtttacccccgatacgtttacccgtaagttaaccg

SEQ ID NO: 143163 - DNA, 833 bp, Homo sapiens
  misc_feature: GYAE6OF02ITPVE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccacttccctccctgttctcggaccgaaccggttggggaacgtaacgtaggttcgtaccaacctacttccgtaaccgtttcggacccggggactaaacgggtaccgggaacttagtttacgaacctaaccgtttaaagtttttaaacgttggttaattaccaaactaagtaacggaacccggacggggtacccggtacccccgtaacgtacccttaacccgttaattccttaagtcgtcgtacgaccttaccgttaccttaggtttacggtacgtaaacgggttcgggtacccctaggtccgtacggttaccgaggtcggtacgtaggtacggttagtcggtagggtacgtacgttactttacgtaccgttactaccgaactactacgtaacttacttcgtacgcgtaaacgtagtaacgtttatttacgtaacttaacgtttacttacgtttacgtaacctaaacgtaacgttaaactttaacgttaacgtttacggtttaaccggtaaccggtaacggtacctaaccggtaaacttaaacgtaaaacgttaaaccggtaaacctgggttaacgtcgttacgtacccgtaacttacggttacttacgtaccgtttacgttacccttacccgttacccctaccgttacttaccggttacgttaaccgg

SEQ ID NO: 143164 - DNA, 673 bp, Homo sapiens
  misc_feature: GYAE6OF02JCGK6.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattggggtttgggggagtctcggtcaggacacagcatggacatgagggtccccgctcagctcctgggggctcctgctactctggctccgaggtgccagatgtgacatcgagctggacccagtcctccatccctcctgtctgcaaccggtgggaanacagtgtccaccatcacttggcccgggacaacggtcggaaactattcgaacaccttaatttaaagttggtatacaactatagaaccgagggaccggacccctaagcctacctaatctatgctgcatcctagttcgacgaaggtgggtcccagtcgtacggtcgtagtggcaggtggtactcgtagggactaagtactttaccacgttctaccgacctacgtactagtactactacggtacgtaacgtagtaagttactttcgtacttaacttacgttacgttactaacgtaaacgtaactaagtttaaactagtttacggttttacggaacccgttaagggtaaccgtaaaccggtaacttaaaacgtaaacgttaaaaccgtaacgttacgtacggttactacggactaaccttattccttacgttactttctaccggttccttacccggtacctacttaccgtacgttaacg

SEQ ID NO: 143165 - DNA, 896 bp, Homo sapiens
  misc_feature: GYAE6OF02HSUQF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggcctccgaggtgccagatgtgacatcgagctcgacccagtcctccactcctccctgtcctgaccaaccggtgggacgacgagttcgtaccaccgataccgtacgttacggacccgggactaacggtacggaaactagttacgacctaaccgtttaaagttttaaacgtttagtagtaacctaactaaacgtacggaaccggtaccggggtacccggtaacccccgttaacgacccttaaccttaaaccgttacccgtagttacggtccgttacgaccgtacgtaccgtaaggttttacggaaccggtaaaggggttcccggggtacccgtaacggttacgggttaccggtttacgagggttacgacggttacggttaggtagtaccggtacgggtaaacgttacggtaacctttacgtaccgttaccctaacccgaacgtaccgttaacccgttaaagtaaccgtttacgacgttaacccggtaaaggtacgggtttaattaacgtttaaccgtaccgtttaaactttacctttaggttaaccttaacgtaaaccgtaaagttaaactttaacgtaaccggttttacggtttaacccggaaaccgggtaaccggtaacccgtaaacgtaaccttaaaacccgtaaaagtttaaacccgggttaagttaccggtaacggttaccggtaacccgtaaccgtacctaacggttcctacccgtttattacccttaccggtccctttaacccggccgttaaccttccgaacgttacg

SEQ ID NO: 143166 - DNA, 682 bp, Homo sapiens
  misc_feature: GYAE6OF02F8QIS.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtncctccatcagtagttggtttcttcgtggggctggggtccggcagcctcccgagggggaacgggtctaggaatactagttgggaagttgtcctctacagtaggtgggtagttcctatttaacagttcccgtctctacgaagtagtcgacgtacaacctatatctacgtggtaactaccgtccagcaaatcttacgttttccctagaagtactgtagtttctgtacggaccgtccgcgtagacgtacgggtacttttatccttgtcgcgacgtaaggacggtcttattagttgttacggttttaggtaggtttaggtttcttaccgtaccgtaaccctaggtccgtacgggccggggtcctccggtccccggcgggtaccgacgggtacgtacggttcgtaccgtccgttacctccgtaccgtccctcccgaccgggtaaccgacccgtacgttcccgttcccgttccccgtcggtacccctccgttacccgtaccgtaaccaccgtacccg

SEQ ID NO: 143167 - DNA, 820 bp, Homo sapiens
  misc_feature: GYAE6OF02HOVB4.46.67.G01.1.454.CMB.1.raw
  modified_base (160)..(160): a, c, t, g, unknown or other
  misc_feature (160)..(160): n is a, c, g, or t
  modified_base (790)..(790): a, c, t, g, unknown or other
  misc_feature (790)..(790): n is a, c, g, or t
  modified_base (816)..(816): a, c, t, g, unknown or other
  misc_feature (816)..(816): n is a, c, g, or t
tcagactagcagtacacgaccggtgctcgatttagagtatacatattggggtttggggagtctcggtcaggacacagcatggacatgagggtccccgctcagctcctggggctcctgctactctggctcgaggtgccagatgtgacatcgagctgacccngtctccatccctcctgtctcgacaaccggtgggacgacaggtcgtaccacctatcctacgttcggacccggactaaacggttcggaaacagtttacgaacctaaccgttaaatttttaaaacggttgggtaacttaccaaaacttacgtaaacggaaccgtaacgggggaacccggtaccccctaaaaggtcccttaaccccgttaaagttcccttaaacggttcggtacccgttacggtaaccgtaacgtttacccgttaagggtttttacggaacggttaaaaacgggggtttcccggggtaaccccttaagggttacccgggttaaacgggttttacggaagggtttacggggaacctaaggggttacggtacgttaccggtaggggtaacctaaggtaaacttttcccgaacttcccggtaacgtaacccttaagtaccgtaacgttaactcgttacgaacgtaacggtagttaacgttaatttaccggacttaaacgtttataccgttacgtaacaaaccgtataaacgttaacgttacgttacgtttacggaacggtaacggtactaaccgtaacttaaacgtaaacgttaaacgacgtagcggtactcgaacgtactgtcctntactacgtctaccgtcctagtctacngtac

SEQ ID NO: 143168 - DNA, 680 bp, Homo sapiens
  misc_feature: GYAE6OF02GVN15.46.67.G01.1.454.CMB.1.raw
  modified_base (233)..(233): a, c, t, g, unknown or other
  misc_feature (233)..(233): n is a, c, g, or t
  modified_base (294)..(294): a, c, t, g, unknown or other
  misc_feature (294)..(294): n is a, c, g, or t
  modified_base (433)..(433): a, c, t, g, unknown or other
  misc_feature (433)..(433): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttcggccgggcaaggtcggaactnttgaccaccttatttaaattgttatcaacatagaccagggacggcccctaagactcctaanctatgctgcatcctagtttgactaaagtcggggtccagtcgtagttcgagtgcagtgatcgtggactagtattacacgtccttcaacctataccaaggttaatcctagacgtaacggttagtaaacgttacgtttttanaaccttaactttaactttacttacggttacaaaccgtaagttaaacttaacgtaacttttcggttttaccggtaccgaaaacgggttaccaaccgtaaaccttaaaccgttaaaaacgtttaaaacccggaaacgtttacgggttacgggtaccttaccggtaccgaaacccttagttaccgttaccgtttaccgttaccttaccgttacccttttacccccggaccttacttaccttaggtaaccc

SEQ ID NO: 143169 - DNA, 841 bp, Homo sapiens
  misc_feature: GYAE6OF02FY7IR.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagcctgacccagtcctccatccctccgttgtctgacaaccggtgggacgacaggttcgtcaccatcctaacgtttcgggcccggggactaacgggttaccggaaactagttacgacctaacccttaattttaaacgttggttaactacaactaagttacgaaccgaggggaacccgtccccgtaagtccgtacctaacttcgtaactcgtacgtcggactacgtccgtaggtttacgaacggtaacggggtccgggttcctaaggtcggtacggttacgaggttcggggactagggtcggtagttcgtacgggtacgtacgttacttccgtacttcctacgtaccacgtaactaacgtttaatccgttaggaaccgtaaacggtttcggtaaagtttgttttaccggtaacctttaaccgttttaacgtttaccgttaacggtaaacccttaaaacggttaaccgttaaaactttaacccgtttacggtttaacgggttttaccgggtaaccggttaaacggggtaaccctaaccggttaaactttaaaaccgtaaaacgtttaaaacccggtacggttaacgttcggggtactacctaacccggttaaccgtaccgtttacgtttaacccgttctttccgttacctttcccggtttaccccacgtttaccgttacgttacgttaccgg

SEQ ID NO: 143170 - DNA, 784 bp, Homo sapiens
  misc_feature: GYAE6OF02H0WZX.46.67.G01.1.454.CMB.1.raw
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
tcagactagcagtacacgaccggtgctcgatttagagtatacatattgggtttgggggacctcctgtgcaagaacatgaagcacctgtggtttgtaaaaaaaacctccgtgctggtggcagctcccagatcgggtcctgtcccgtggtgcaactgcaggcgtcgggcccacgactgggtgaggccttcggacgcctgtccctcacctgcgntgtctcgtggtcnccgtccatcgtagttaggttcggtttcgttcgtggggcgttcgggtccggcacgcctaccggaggggaaggggtcgtaggtaactaacgtaggttaggaacgtgttctctacgagtaggtggtacgttaccgttattacacgtccgtctctacgtaagacggtacgtaacgtacctacctaacttacgttacctacgtaccggtacctaccggtcgactaaacgtaacttaccgttaccgtttttaccgaacgtaaagtagttcgttagttttccgtcgggtacccgacccggtcccgtaggtaccggtacggtaaccgggtttcgtttacgtttacgtcggttacgacggtacgacgggtaaccgattttacgttagttacggtttaaggttttgggtaaggtttcgtttagttaaccgtaccgtaccgtagaccggggttcccggacggggtacccgttacccggggacccgggttcggggtaaccggaagggttaaccgttcggtaccggtacccggttaccgttacccgttcccgtttcccgacccgtacccccgg

SEQ ID NO: 143171 - DNA, 818 bp, Homo sapiens
  misc_feature: GYAE6OF02IF8G6.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccagactggtgaggtcttcggagaccctgtccctcaccgtgcgctgtctcgtgtcgcccttccatcaaggtgttggtttctcggtgggctggggtccgcacgcctaccggaaggggacggggtctagggaacttacgagtttcgggaaacgttgtaccgttcactaagttaggtggtacggttacctagttacagtccgtctctacgagtacgtcgacgttaccactagtactcgtacgtacggacctaacgtcaacgactaacttcgttaccgttttacccagtaacgagtacgttcgttacgtcgtaaccggtcccggtccgtacgtacggtaaccggttacgggttacgttttaacgtccgttagtaccggtacggtaacgtacggtacggtacttaagtttacgttagtttaggtttcggtaaggttttcgttaacgtttccgaaccgtttaaccgtaacgtccggtaaccggggtacgggtacccgtacccgggttaaccccggggacggggttaaccgtaccggggtaagtttacccgggtacgttaacccgttaccgttcccgtttaccgtaccgtaccccgttaaccggtaacccggaaccgttacccggttacttacccccgggtttacccgttacccccggttcggccccgtttaacccgacccccgttaacggaccgttaccgtaccccggg

SEQ ID NO: 143172 - DNA, 865 bp, Homo sapiens
  misc_feature: GYAE6OF02HNHOW.46.67.G01.1.454.CMB.1.raw
  modified_base (812)..(812): a, c, t, g, unknown or other
  misc_feature (812)..(812): n is a, c, g, or t
tcagactagcagtacacgaccggtgctcgatttagagtatacatattgggtttgggggacctcctgtgcaagaacatgaagcacctgtggtttgtcctccctgctggtggcagctcccagatgggtcctgtccctggtgcaactgcaggagtcgggcccaacgactggtgaggccttcggacggacccctggtacccctcacccgttgccgtcctggttcctacgttggtccgcctacccctagtacctaaggttcggttttacggtttttccgttcggtcgggggccgttagggggttccccggcgacgtccgttacccggagggggaacgggggtccgtagggtaacctacgtaggtttaggtaaacggttcgttaccgtactaccgtaagttaacgggttcgggtacggttttaaccttaacttaaccggtacggtttccctacgttcgaccggtaaaagtaccggttccgtaacgtacccaacgtacttaactccgttaccgtacggtaaaccgcgttacccaagtacctaaacgttccttaacgttttacccgagttaacgagtttcgtacggtttactcgggtaacgtccccgggtccgtacggtaccgtaacgggtttaccggggttacttttaaaggttcccgaagggttacgtacggacgttaagggaccgttacttaggtttaacgtgggtttttatttacggggtacgtttaggtttaccctttacgaccgttaccgtagtacgggccgggttacgggccccgttacccgggccgggtaccgggtactaacggggttaacnccggttcccggaaccgtcgttaacccgttcccggttaccgcccctaacccggg

SEQ ID NO: 143173 - DNA, 892 bp, Homo sapiens
  misc_feature: GYAE6OF02IHF2O.46.67.G01.1.454.CMB.1.raw
  modified_base (145)..(145): a, c, t, g, unknown or other
  misc_feature (145)..(145): n is a, c, g, or t
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
tcagactagcagtacacgaccggtgctcgatttagagtatacatattgggtttggggagtctcggtcaggacacagcatggacatggagggtccccgctcagctccgtggggctcctgctactcgtggctccggaggtgccagtntgtgacagtcgagcgtcgacccgngtcctccnctccctccctgtctcgaccgtaccggtgggacgacgtagtcgtaccacctatacctcggtcggaccgggtacgtaaggtaccggtaaatagttaccgaaccgtaaccttttaaagtttaaaagttcggtaaactaccgtaaataacgtaacggaacccggtaacggggtaacccccggacccgttaaacggtacccttaaccgtaagtaccgttatccggtcttaacggcctaacggtttacccttaagggttaccggtaaacggaaaccggggttccgggtaaccctaaggggttccggtaaacgtttggcggttaacggtccggtaagtacgggtaccgttacggggtacgggtaacgttacggttcccttacgtaacctttcggaacccctaaagttacgtttaaccgttaaagtaacgtctaacggaaccgggttaaagtaacggttaagtttaggtttaccgaactttaaagtttacgtaaaccgttacggttaaaacctagggtaaacttttaaacgttaacttaaccggggtttaccgttaaccgaacgggtaaaccggtacaaaaccgttaaacgttaaaacgtaaaccgttaaaacggtcgttagtaccgggtactaacccggtctaaaccgtacgttttaccaccggtttactttacccaaccggttttacccgcccgtttaacgacttaccgtaggttaacccc

SEQ ID NO: 143174 - DNA, 796 bp, Homo sapiens
  misc_feature: GYAE6OF02H7MYT.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcctttcgggagaccctgtccctcacctgcgctgtctcgtggtgccctccatcagttagttggtttcttcgtggggtcgtggggtccggcagccgtcccggaaggggaacggggcgtaggaatactagttaggaagttgtctctcagttaggtggtagttcctaattacacttccgtctctacaagtagtcgaagtacacctaatatctcgtaggactaccgtcaagtactaatacttacgttttacctagaacgtatacgtagttttcgtgtacggacccgtccgacgtacggaccggtacgggttaccgtttttaattaccgtggttacgacggtaaaggaacgggtaccggttacgtttaagtttaagttaggtttaaggtttttaagggtaacggtttagggtttttaacctttaccggtaacccgttaacccgttaaacggtacggtttaccgggtaaccggggggtacccttacccgggtacccggtacgggggtaccgtaacggggtaaacgttaccggttacgggtaccgttaccgtaccgttacccttaccgacccgttacccgaaccggtaacgggtacccctacggtaccccgtttacccttacccccgtcggtaccccgtaccccttacccgaaccgtaaccgacgttaccccg

SEQ ID NO: 143175 - DNA, 806 bp, Homo sapiens
  misc_feature: GYAE6OF02GSGZL.46.67.G01.1.454.CMB.1.raw
  modified_base (120)..(120): a, c, t, g, unknown or other
  misc_feature (120)..(120): n is a, c, g, or t
  modified_base (436)..(436): a, c, t, g, unknown or other
  misc_feature (436)..(436): n is a, c, g, or t
  modified_base (488)..(488): a, c, t, g, unknown or other
  misc_feature (488)..(488): n is a, c, g, or t
tcagactagcagtacacgaccggtgctcgatttagagtatacatattgggtttggggagtctcggtcaggacacagcatggacatgagggtcccgctcagctcctggggctcctgctacnctggctcgagtgccagatgtgacatcgagctgaccagtctccagtcctcctgtcgtacgacgaaccggtgggactaccagtcgtaccaccattccacgttggcccgggactaacggtaccggaactagttcggaaccttaaccgttaagttttaaaacttcggttaactacaaacgtactaacggaaccgaaggggtaaccggcccccttaaaaggtccttaccgtaaacttaccgtatacggtcgtagtacgtaactcccgtaggtttggaactaaaggggtcggttacccgagtccgtaggtttcaggtggacnggtacgatcgtacgggacagtacttcgacctctacgactacgatagttaacncgtagtaaccaacgtagaaaggtttattttgtaaaacctttatacgtattaacccgtaaagtaccgttaaaattaaccgggttaacgtttacgggtttttacccgaagggtaaaaacccggggttaaaccaaacgggtaaaaacccgttttaaaattaaaaacccgggtttaaaacggttaacccgtttaagggaccggtttacccgtacgtaaccgtacctaaaccgttttacggttaacgttaccccttttaccggtaactttaccccgtttaacggaccccgtttaaacgttcgtttaaccgacggtttaacccg

SEQ ID NO: 143176 - DNA, 859 bp, Homo sapiens
  misc_feature: GYAE6OF02F1BVN.46.67.G01.1.454.CMB.1.raw
  modified_base (172)..(172): a, c, t, g, unknown or other
  misc_feature (172)..(172): n is a, c, g, or t
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctcatcagtgttggtttcctgtgggctgggtccgnacgctccgagggagggctggaatacagttggatgtctctcagttagtggtacggttacctagttacacgttccgttcgtctcgaaggtcgtacgtacgtacaacctattactccttacgtacggaacctaccggttaccaggacctaacgttcgttaccgttttttaccccgtaaggtaaacgtacgttaggttacgtttcggttacggttaccgggacccggtacccggccgtttaacggaacccgggttaccgggtttacggtttttaacgtttaaccggttcgggtacggaacggttacgggaaccgggtaccggttacgttttaacgttttacggttttacgggtttttaacggttttttacggggtaacgggtttttacggttttaaaccggtttttacccggtaaacccgttaaccggtttacgggttaaccgggttacccggggtaaaccggggttcccggtaacccgggttccccgggtacgggggtacccgtaagggtaaacgtttccgggttacggtaccgttacccggttcgttacccgttaccgtcccgtaccgtaaccggaccggtaccctacggttccccggttacccgtttccccgtcggtcccctacccgtcccgtaactacgaccgttacccgg

SEQ ID NO: 143177 - DNA, 919 bp, Homo sapiens
  misc_feature: GYAE6OF02G0SRH.46.67.G01.1.454.CMB.1.raw
tcagactagcagtacacgaccggtgctcgatttagagtatacatattgggtttgggggagtctcggtcaggacacagcatggacatgagggtccccgctcagctccgtggggctcctgctactctggctccgaggtgccagatgtgacatcgagctcgaccatctccatccctcctgtctcgacaccggtggacgactaggtcgaccaccgtataccgtacgttcgggacccgggagaaacggtaccggaaactacgtttaccgaaccgttaaaccgtttaaattttaaacggttaggttaaacctaacctaaaacgaagttaaccggaacccggtaacggggaacccgtaaccccgtaaggtacccttaaccgtaacttaacgttacgtacgttccgtagtacctaacgttaccgtaaggtttaccgaacggtaaaccggggtttcgggtaacccctaagggttacccgggttaggtttaacccgtaggggttcggtaacccgtaagggttccggtaaacgttacggggttaagggtaacctttaacggttaacccgtttaccaacccggtttacccgtaaacccttaacccggtaactttaaccgtttaaacggtaacctttaaccggttaaccggtaaaccgttaaaccggtaacggtttaaacgttaagtttaacgaacgtttaaaccgtttacgttaaccgttactaaacctaaacggttaattaaaccgtttagttaaaccgttacggttttaaccggaaccgtaaacggtaaaccgaacttaaaccgttaaaacgtaaaaactttaacgtaacgttaaccggtacgtaccgtaaccgtacgttaaaccttacggttacctacgttaccttaacttaccggtcccgttacgtacctagttaccgtaggttacc

SEQ ID NO: 143178 - DNA, 693 bp, Homo sapiens
  misc_feature: GYAE6OF02HTETW.46.67.G01.1.454.CMB.1.raw
  modified_base (181)..(181): a, c, t, g, unknown or other
  misc_feature (181)..(181): n is a, c, g, or t
  modified_base (477)..(477): a, c, t, g, unknown or other
  misc_feature (477)..(477): n is a, c, g, or t
  modified_base (543)..(543): a, c, t, g, unknown or other
  misc_feature (543)..(543): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctcgacccagtcctccatccctcctgtccngaccaacggtgggagacgtaggtcgtaccaacctacgttcctacgttcgggacccggggtactaaacggtacgggaaacctattacggacctaccgtttaattttaaaggttggtaactaccgaagtacgtaacgaccggaacggggtacccgaccccgttaagaccttacctaaatctaagtcgactcgactacttaccgtagtttagacggtaacggtcgggtaccctgtacggtacgttacgaggtgacggtaggtagcgttcggaggtacgtaattacgttaccactcaacncctagtactaacgtactccggtagaaccgttacggtagtaagttagtttaccaactttaaacgttnttacgtataaccgaattagttaaactattaaggtttcggtaccgaacggaacgtaaccgagttaacctaaagttaaactaacgtagttgacgtcgagtaactcgttacgcgttcctcgtaccttcgttaccgcctacgtactgtactacg

SEQ ID NO: 143179 - DNA, 676 bp, Homo sapiens
  misc_feature: GYAE6OF02GD1XA.46.67.G01.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (665)..(665): a, c, t, g, unknown or other
  misc_feature (665)..(665): n is a, c, g, or t
tcagactagcagtacacgaccggtgctcgatttagagtatacatattggggtttgggggacctcctgtgcaagaacatgaagcacctgtggtttgtcctcctgctggtggcagctcccagatgggtcctgtccctggtgcaactgcaggagtccggggcccacgactgggtgagggccttcgggagaccctgtcccctcacctgcnctgtctctggtcncctccatcagtagttggtttctcgtggggctgggtccggcacgcctccgaggggacgggctaggaactacagttggagttntctctnatggtgggtacgttactattacgacgttccgtctctacggaagtagtcggatccaaccattactctacgtacggacaccgttcgaacgactaactcttaccgtttacccagtaaagtctttaggtacgttcgtcgtacggacccgtccgtacgtacggtacgacgggttacttttaactacgttggtcgacggtaaggtacgtacggtacttaagttcgttagttaggtttttggacgtttaggttttactacgtacccgtaacgttaggttcgtaccggggttaccggcggttacccgacccgggtaggggacctaagggttaacttcggtcgtacgtacccgttcgtacccgttacnccccgtaaccg

SEQ ID NO: 143180 - DNA, 723 bp, Homo sapiens
  misc_feature: GYAE6OF02FXUNR.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtcgggcccagactgggtgaggcccttacggagacccctgtcccctcacctggccgctgtctcgtggtcncctcatcagttagtcgtttctcgtggggcttcgggtccgcagcctcccgaggggaacgggcctaggaatacagttggaagtcgtctcgtactagtacgtggtacggttcctaattacgcgttccggtctcgtaccaagtacgtcgacgtcaccgatactcctagtcggactaccgtaccaggtacctaattccgtaacgttttcccgaaggtaacgtagttcgtagtttcgtcgtcggtacccgccgtcgtacgaccgtacgggttaccgtttactgtaggttgaccggtagacggacgtcttagttagttacgtttaggttttacgggtaagtttcgggttttacttaccgtaacctaccgttaacggtacgttacccggggtaccggggttccgtaccccgggtaccccgggaggggtaccccggtaagggttaaccgtaaccggttccggtacccggttcccgttacccgtttacccgtaccgttccccggtaaccccgg

SEQ ID NO: 143181 - DNA, 725 bp, Homo sapiens
  misc_feature: GYAE6OF02G5J4C.46.67.G01.1.454.CMB.1.raw
  modified_base (211)..(211): a, c, t, g, unknown or other
  misc_feature (211)..(211): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggnacgcctccgaggggaacggggctgggaatacagttggaagtgtctctcatagtggaggttcctattacagtccgtctcncaagngtcgagtcaccatactctcgtaggactacgtccagacctaaagttcctacgttttccctaggaacgtataggtacgttcgtaggtcggaacccgtcccgtcgtacggaaccgtaccggggttactttttaacgttacgttggtcggtacggtaggacggtacggtacgttagtttagttagttagttttagggttaggtttggttttacgtttacgtaaccgtacccgttaagtacgtcgggtaccggggtccgtacccggtaccccggtacgggaccggtacgggtaacgttacgttcggtaccgtaccgtaccgttaccgttaccgtacccgtacccgtacccggaaccggtacccgtacgttcccggttacccgtccccggtttttttaccgcccgtacccctcccgtacccgtacgaccgtacccg

SEQ ID NO: 143182 - DNA, 658 bp, Homo sapiens
  misc_feature: GYAE6OF02GTPO5.46.67.G01.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (428)..(428): a, c, t, g, unknown or other
  misc_feature (428)..(428): n is a, c, g, or t
tcagactagcagtacacgaccggtgctcgatttagagtatacatattgggtttggggagtctcggtcaggacacagcatggacatgagggtccccgctcagctcctggggctcctgctactctggctaccgaggtgccagatgtgacatcgagctcgacccagtcctccatcctcctgtctgactacggtgganacagtgtacaccntcacttggccggacagtcggaactntcgactaccttatttaaagttgatacaactagtacgaaccgagggaccgtaccccgtaagcctaccttaattcttaagtcgactgccagttccgtagtttcgaacgtaagggtccgggtacccaagttcggtacggttcgaggtcggactaggtgtacgtcggtaggtaactagtctttaccacgtcctacacctntaatacgtatccgtgacgtaacgtagtaagttacttacgaacttaacgttatacgtacgtactaaacgtataacttacgtacgtttcgttaaccgaccggtaaggtaacctaggtaacctaaacgttaaaacgtaccgtaagtacgtacgtcgtactaccgttactaaccgtcgttacgtttcctacgttaccgttccccttaaccgtcgtaaccttagttaccttaacg

SEQ ID NO: 143183 - DNA, 599 bp, Homo sapiens
  misc_feature: GYAE6OF02HZYBX.46.67.G01.1.454.CMB.1.raw
  modified_base (304)..(304): a, c, t, g, unknown or other
  misc_feature (304)..(304): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgcacatcacttcggccgggacaaggtcgggaacattagactaccttaatttaaatggtatacaacaatacgaccgagggacgaccccgtaagcctacctaatctancgtctacgctactaccgtaggtttacgacgtaaggtcgggtacccagtcggagttcgaggtganaggtgagtcgagganagtacttcactctcactatcgagtatcgtagctaacgtagtaagtgtttacgactaacttcgttaacgttactacaacgtaagttaacttaagtagtttcggttaccgaacgtaacggtacaacgtaactaacgtaaacgtaaacgacgttagtacgtacgtgaccgtacactcgtacttactactacgttcctacccgtactctacgtataaccg

SEQ ID NO: 143184 - DNA, 741 bp, Homo sapiens
  misc_feature: GYAE6OF02JYV6D.46.67.G01.1.454.CMB.1.raw
  modified_base (167)..(167): a, c, t, g, unknown or other
  misc_feature (167)..(167): n is a, c, g, or t
  modified_base (444)..(444): a, c, t, g, unknown or other
  misc_feature (444)..(444): n is a, c, g, or t
tcagactagcagtacacgaccggtgctcgatttagagtatacatattgggtttgggggacctcctgtgcaagaacatgaagcacctgtgtttgtcctcctgctggtggcagctccagatgggtcctgtccctggtgcaactgcaggagtcgggcccacgactgggtnaggcccttacggacgacccctgtcccctcacctcggcgccttgtctacgtggtcaccctccattcagttacgtggttttctcgtggggctcgggaccggcagcctaccgagggaaggggtctggaactacgtagttaggaagtgtcctcgtacagtacggtggtaacggttccttaagttaccgacgttccgtccttcgtacgaacgtacgtcggtacgtccgaccactactctcgtaggctacgtccagtacaactcgtacgttttcccaggtaanctttgtacgtttctggtacgtacccgaccgtcgtacgtaccgtacgggttactttacgttaccgtaggttacggcgaaggtacgtaccgggttacgttaaattacggttacgtttaggttttacggtagggtttacggttactttaccgtaaccttacccggtaaggtaccgttaccggggacggggttaccctcccgggtaacccggttcggggaacccgtaagggttaactttaccggttacggtaccccggtaccgtttccttaaccccggtttacgtccccgttaacccccgg

SEQ ID NO: 143185 - DNA, 967 bp, Homo sapiens
  misc_feature: GYAE6OF02FWQ5R.46.67.G01.1.454.CMB.1.raw
  modified_base (153)..(153): a, c, t, g, unknown or other
  misc_feature (153)..(153): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgagggccttcggagaccctgtcccncacctgcgctgtctcgtggtcgtcctaccatcagttaggttcggttttccttcgtcgggggcttcgggggtcccgacgtaggtccgtacccggagggggtaacgggtctacgggtaaattaccgagttgggaagttcgtcctacgtactacgtaggtggtacggttcctagttactacgtacccgttctacgtacaaagtacgttccggaacggtacaccgtaacttactaccgttccggtaacgggtacctaaccggtaccgaacggtacctaaacttcccgtttaacgttttttacccccaaggtaaacgtaacgtttaggttacgttttaccgtaccgggtttacggtaccccggaccccggtaccgtacgggttaaaccccggtaccggggtttaccgtttttaaaccggtttccggttacgggtccgggtaacggtaacggggtaacggtaacccgggtactttaaaccggtttagtttacggtttaacggttttttagggttaaacggtttttcgggtttaacttttaacccgggaacttaccccgtaagggtaaccgttcccgggggtaacggggttcccgtaccccggtaccccgggggtacggggaccccggttaaaggggtaacgtttaccggttaccggtttaccgtacccggtttaccgtttaccccgttaccggaccccgttaacccggaacccggtaacccggggacccttacccggttaacccgggttccccttacccccgggttacggacccccgttacccgttacccggtaccctaaccgggtaccgtaccccccgg

SEQ ID NO: 143186 - DNA, 675 bp, Homo sapiens
  misc_feature: GYAE6OF02IBHG4.46.67.G01.1.454.CMB.1.raw
  modified_base (251)..(251): a, c, t, g, unknown or other
  misc_feature (251)..(251): n is a, c, g, or t
  modified_base (320)..(320): a, c, t, g, unknown or other
  misc_feature (320)..(320): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggcctttgggacgaccctgtccctcacctgcgctgtctctggtcgcctcatcagttagtggtttctcgtgggctgggtccgangtctaccgagggacgggctaggatacagtggaagtgtctctctataggtggacggtttacctagttacncgttccgtctactacgaagtacgtcggtactacgacctatacttacgtctacggtactaccgtccagactaaattcgtacgttttccaggtatacgtgtacgtttcgtacggtacgaccccgtcgtacgtacggtaccgtacggggttacttttaacgttacgtcgtacggacggtagtaccggtaccgttataaagtttcgtaggttttagttttagggtagtttcgtttacgtttacgtaccgtaaccgtagttacggaccggtacggggtcctacccggtaccgggtaccgggtacgtaacggtaacgttcgtacggtaccctccgttccgttacgtccgtaccctacccgg

SEQ ID NO: 143187 - DNA, 745 bp, Homo sapiens
  misc_feature: GYAE6OF02I0FD1.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgganacagtgtcaccatcacgttcggccgggacaaggtcggaacattgacctaccttaatttaaattggtactacaacatacgaccgagggaccggacccctaagcctacctaactctatgctgctactcctagtttcgacgtaagggtcgggtaccattcggagttcgaggtggacgtaggtacggtagtccggtaggggaacctagttacgtttaccaccttactaccgtacctacgtacgtaagtttaactccttacggaaccgtaacggtaggttaacgttagttttacgaacctttaaacttttactttacgttaacgttaacgtaaacgttaaacgttaaagttaaacctttaacggttttccggttttaaccggaacccgggttaacggtaaccgtaaacccgttaaccttaaaacgtttaaaccgttaaaaccgtaaccgtttagtacggttaccgtacgtaacccgtaacctttacgttaccttaacgttcctttaaccgttacgtttaccccgttacccgtaccgtttacgttccgtacgttaaccg

SEQ ID NO: 143188 - DNA, 781 bp, Homo sapiens
  misc_feature: GYAE6OF02IJU67.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggagaccctgtccctcacctgcgctgtctctggtncctcatcgtagtgtttcgttctgggcgtcggtcggcgcgcgtccgacgggaagggcggtgtaagtatacgtaggtaggtatcgtctcgtagtagtggtaggttccgttacttaacgtacgtccgttctctacgaagtacggtcgtacgtacctaccaactattcgttcctacggaccgtaccgtaccacgagtaacttaccgttcgttttacccttacggaagtacgtagtacgtttcgttcggtacggacccggcccgtcggtacgtaaccggttaccggggtaccggtttttacgtttacgttaggtcggtacggtaacggtaacgggaccgttcgttattttaacggttagtttacggtttttagggtcgggtttagtttcgtttaccggtaccttaacccgtacgttacgggtaccggggtccggggtaccggtccccgtacccggggtacgggtacggaaccggtaagttaccggtaccgtccgaacccttcccggttccgtacccgtcctacccgccggaaccggtcctaccgttccggttaccccttccccgtacggacccctccccttacccgacccgaacggtcccgtcctacccggg

SEQ ID NO: 143189 - DNA, 750 bp, Homo sapiens
  misc_feature: GYAE6OF02HVST2.46.67.G01.1.454.CMB.1.raw
tcagactagcagtacacgaccggtgctcgatttagagtatacatattgggtttggggagtctcggtcgggacacagcatggacatgagggtcccccgctcagctcctgggggctcctgcctactctggctccgaggtgccagatgtgacatcgagctcgacccagtctccatccctcctgtctgaccgtaccggtgggacgactagtcgtaccaccatactcttcggacccgggctaaggttccggaacttagttacgacctaacctttaatttaaagttcggtaactacaactagtaacgaccgacggggtaccgccccctaagtcctaccttaataccttatcgactgtcctacgttccgttagtttacgacgtaaacgggttccgggtaccctagtcggtacgttcgaggtggactggtacgtacttcggagggtactagttacgttaccactctaccacgtatacgtataactcgtacggaataaccgtagtaactttagtttacgaaccttaacgtttacttacgtacgttaaccgtaacgtaaacgttaacttaaaccgttattttaccgggtttaaccgaaccgtaaaccggggacctaaccgtaacgttaaaccgttaaaccgttaaacggtaccgtacgttcgactccgtaaccgttaccgattttccgtacgtttaaccttcgttaaccccgtttacccgttccccgtacgtttaccctcggttacgtaccgttaaccgg

SEQ ID NO: 143190 - DNA, 654 bp, Homo sapiens
  misc_feature: GYAE6OF02FRSJE.46.67.G01.1.454.CMB.1.raw
  modified_base (314)..(314): a, c, t, g, unknown or other
  misc_feature (314)..(314): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagcctccgaggggaagggctggaatacgattggaagtgtctactcagtagtggaggttcctattacgtagtccgtctctcgaagagtcgagtacaccatatctngactacgtccagctaatctacgtttccctagaacgatggagttcgtgtacgaccgtccgctggaactcggggtacgtttataccgtgtcgcgagacgacggacttaacgtttagtgttagttttgggtagttaggtttacgtttacgtactacccgtagtacggtccgggtacggggcctaccggtaccccgtacggggacccgaaggggtaacttaccggttccgtaccgtacccgttacgttcccgttacgtccctccaaccggtaacggacccgtacgtcccggttaccccgtccccgtcggtaccccaccccgttcccaccgtaagccgtaccccg

SEQ ID NO: 143191 - DNA, 889 bp, Homo sapiens
  misc_feature: GYAE6OF02F4J4R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatcctccctgtctgccaaccggtgggagacagtgtcaccatcctacttcggaccgggactaacgggtaccggaaactattacggaacctaaaccctttaaagtttttaaaagtttcgggttaattaccgtaaaaccgtaagttaaccggaacccggaacgggggtaacccgggacccccccgttaaaacggccttaacccccgttaaacttaccgttaacgttccggtaccgtacggtacctaacgttaccccgttaaggtttttaccggaaaccggtaaaccggggttcccgggggttacccccaagttaccgggtaacgggtttacgtaacgggttcggacgtaacgggttcgggtagttaccgggtacgggacgttaaggtaaccgtttacccaacgttccgtaaccaacccgttacgtaaccgtaagttaacttccgtacgtaccgtaaacggtacggttaaagttacgttttaacgaaccgtttaacgtttaactttacggttacgtaaccttaaacgtaaacgttaactttaacgttaacggtttacggtttaacccggaaccggtaacggtaacccgtaacgttaaacctaaacgttaaaacgttaaacgtaaccgttacggtacggtacttacggtacctaacttaccgttaccgtttacgtaccttaccgtaccgtttaccccttaccggccttacggttactacggttacc

SEQ ID NO: 143192 - DNA, 869 bp, Homo sapiens
  misc_feature: GYAE6OF02G43I5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgagtgccagatgtgacatcgagctgacccagtctccatccctcctgtctgcgaaccgtgggacgacagtcgtaccaccgactcgtaccttcgggacccgggcaaacgggtccggaactagttacggaacctaacccgtttaattttaaaacgtttggtaacttaccaaaacgtaacgttaaccgggaaccccgaaggggggtaaccccggtaaccccctaaagtcccgttaaccttaaacgtttcctaaacgtgtccgtacggtacctaaccgttccggttaacggttttcgaaccggtaaaacggggttccgggttaccccaaggttttacccggtacgggtttaccggtacgggtacggtaccgtaggggttccggaacgtttacggtaggggtaaacccctaggttaaccttttacccgaaccttaccggttaacccaaaccggttactttacgtaaacgtttaacgttacgtacgtaaccgtaaacggttagttaacgtttacgtttaacgtaacccttaacgtttaccggtttacgtaaacggttaacgaaacttaacgtaaacgtttaccgtaagttacgttttaacggaccggtaacggttaccgaacgttaacctaaacgttaaacgtaacgtaaccgtagggacctacgtacgtaaccctcccgtattacgttaccgttacgtaccgttaccttaccggttaccccttaccgtacgttaccgactttaacgg

SEQ ID NO: 143193 - DNA, 686 bp, Homo sapiens
  misc_feature: GYAE6OF02H8M4S.46.67.G01.1.454.CMB.1.raw
  modified_base (296)..(296): a, c, t, g, unknown or other
  misc_feature (296)..(296): n is a, c, g, or t
  modified_base (655)..(655): a, c, t, g, unknown or other
  misc_feature (655)..(655): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagacccctgtcccccacctgcgctgtctctggtcgcctccatcagtagtgtttcttcgtggggctgggtccggcagctcccgagggaagggctggaatacagttaggaagtcgtctctctatagtggaggttcctattacagtccgtctctacaagngtcgagtacacatactctctgacacgtcagcaatcgtacgttttccagaacgtatgtacgttcgttgtcgacccggccgtcgtacgaaccggtacggggttacgttttaactttaccgtaggtacggacccggtaaggtaacggtacgggtaccttaagttttaggtacgtttaaggttttttgggtaacggtttgggttttacgtttaaccggtaacctaacccgttaagtacgtaccgggtacgggggtcctacccggacccgtcggggaccgtagggtacttacgtcgtaccgtaccgtcgtacttacgccctaccgaaccgaggtccctagtcgttaccccgttcccgtagcccncccgttacccaccgaacgtccgcctacccgg

SEQ ID NO: 143194 - DNA, 659 bp, Homo sapiens
  misc_feature: GYAE6OF02GOWQG.46.67.G01.1.454.CMB.1.raw
  modified_base (192)..(192): a, c, t, g, unknown or other
  misc_feature (192)..(192): n is a, c, g, or t
  modified_base (272)..(272): a, c, t, g, unknown or other
  misc_feature (272)..(272): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgganacgagtctcaccatcacgttcggccgggacaagtacggaactagttacgacctaccttaatttaaagttggtactacaanactaacgaccgacgggaccgaccctaagcctactaactctatcgctgactactaccgtagttacgacggtaaggttccgggcctagtacggtaggttacaggtggacgtaggtagtatcggtaggactggttacttaccactacgttacactactaccgtattaacgtctacggtaacgtacggttagtaattagtttcaaccttaacttacttacgttagtacctaagtaagtaattacgtagttacgtttacgacgtaacggactaacgtaactaaacgttaaagtaaacgtactagggttacacgttacctacgtaaccgtatacgttacgttaccttacttacctttacccggtaccccgttatacccggttatacgtaaccg

SEQ ID NO: 143195 - DNA, 689 bp, Homo sapiens
  misc_feature: GYAE6OF02HUHFT.46.67.G01.1.454.CMB.1.raw
  modified_base (416)..(416): a, c, t, g, unknown or other
  misc_feature (416)..(416): n is a, c, g, or t
  modified_base (633)..(633): a, c, t, g, unknown or other
  misc_feature (633)..(633): n is a, c, g, or t
  modified_base (674)..(674): a, c, t, g, unknown or other
  misc_feature (674)..(674): n is a, c, g, or t
tcagactagcagtacacgaccggtgctcgatttagagtatacatattgggtttgggggagtctcggtcaggacacagcatggacatgaggtccccgctcagctccgtggggctcctgctactctggctccgaggtgccagatgtgacagtcgagctcgacccagtctccatccctccctgtctgcaaccggtggagacgagtgtaccacctatctacgttccggccgggacaaggtccggtaactagttacgaacctaacctttaatttaaagttcggtaactaccaacgtaacgtacggaaccgtaacggggacccggtacccctaagtcctaccgtaatactaagtcgctcgactacgttcgtagtttacgaacgtacggtccgggtccagtccggtaggttcgaggtggtacngggtagtctaggtggactagtacttactacctctacgactacgtactagtaactcctacgacgtaacgtagtaagttacgtttacactttaacgttacttaacggtctaacgaacttaataaactttctaacggtttcgggttaccgaaaccggtacggaactaacgtaaacctaaacgtttaaacgtaacgtagtcggtacgtaccgtcgtaaccncttacgttcgtaccttactaccgtcctttcccggacccttntaccgtctagtaacc

SEQ ID NO: 143196 - DNA, 609 bp, Homo sapiens
  misc_feature: GYAE6OF02J0M5B.46.67.G01.1.454.CMB.1.raw
  modified_base (163)..(163): a, c, t, g, unknown or other
  misc_feature (163)..(163): n is a, c, g, or t
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (289)..(290): a, c, t, g, unknown or other
  misc_feature (289)..(290): n is a, c, g, or t
  modified_base (325)..(325): a, c, t, g, unknown or other
  misc_feature (325)..(325): n is a, c, g, or t
  modified_base (427)..(427): a, c, t, g, unknown or other
  misc_feature (427)..(427): n is a, c, g, or t
  modified_base (563)..(563): a, c, t, g, unknown or other
  misc_feature (563)..(563): n is a, c, g, or t
  modified_base (580)..(580): a, c, t, g, unknown or other
  misc_feature (580)..(580): n is a, c, g, or t
tcagactagcagtacacgaccggtgctcgatttagagtatacatattgggtttgggggagtctcggtcaggacacagcatggacatgagggtccccgctcagctccgtggggctcctgctactcgtggctccgaggtgccagatgtgacatcgagctgacccngtcctccatcctcctgtctgcacgtgganagagtcgtcacatctatcggccgganaggtcgaancttgactacttaatttaattcggtatcaanctagaccgaggccgacctagctctatntactnntgacatacgtagttcgacgtaaggtcgggtacctntggtaacggttccaggtcggaccgttaggtggtacgtcggtacgggataacgtttacttctacgtcttacgaaccgtctacgtacgttacgtctacggttanaaccgggtattacgttagtttacgaactttaacgttattaccgttacgttaacaacttacgtaattagttagttccgtttacggacgtacggaacgtacctaacgtaactaactacgtactacggctacgctacgntacgtctagttaccgtntaacgttccaccgtctattccagttaccg

SEQ ID NO: 143197 - DNA, 804 bp, Homo sapiens
  misc_feature: GYAE6OF02HQIU4.46.67.G01.1.454.CMB.1.raw
  modified_base (175)..(175): a, c, t, g, unknown or other
  misc_feature (175)..(175): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
  modified_base (443)..(443): a, c, t, g, unknown or other
  misc_feature (443)..(443): n is a, c, g, or t
tcagactagcagtacacgaccggtgctcgatttagagtatacatattgggtttgtcctcctgctggtggcagctcccagatgggtcctgtcccgtggtgcaactgcaggagtcgggcccacgactgggtcgaggccttcggacgaccctgtccctcacctgcgctgtctctggtncctcatcagtagtggttctcngggctggtccgnacgctccgagggacggctgaatacgagttacggaagttgtcctcgtcaagtaggtgggtaacgtttcctaattacaggtccgttactcactaaaggntcgaagttcaaccgtatctcgtacgtaggaaccacgtaccagtcctaaagttccgttacgtttaccnggaancgttagtccttgacgtcgaccgngtacgtcgacggtaccgggtttatttaagttccgtgggtaacnccggtaagtaacggtaacgtaccgtttagttacgtaggtttacggtttttaggaggttttacggttaacttaccgtaccgtaccgtaacggtacgtaccggggacgggttaccctaccggtaccccggtagggggtacccaaacggggttaaccttaccgggtaacgggttaccctacccgggttaacccttttacccgtaccggtaccccgttttacccggaaacccgggttacccggggtaaccccttaccgggtttaccccgtttacccccggttacccccggtttacggtaaccccccgttaacccccggttacccccgggttaaaccctaacgggggttacccctaaacccccggg

SEQ ID NO: 143198 - DNA, 730 bp, Homo sapiens
  misc_feature: GYAE6OF02I1G4V.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcgtaccggtggacncagtcgtaccacctactcgtacgttcggccggacgtaacggtaccggaactagttacgaacctaaccgtttaatttaaacgttggtactacaacaagtacgaccgagggacccgtacccctaagtcctaacgtaactacgtagcgtctgtacctactaccgttaggttacgaaggtaacggtcgggtaccctagttacggtacggttcgaggtcggacggtagtggtacgtcggagggtacgtagtaccgtttacaccgttacctacgaaccgtagttaccgtaagttacgttacgtaacgtaccgtaacggtacgttaaacgtttacgtttacgtaaacgttacttacgttacgttacgtactaaacgtaacgtaacttacgttaacgtttacgttaacgggtaaccgaaggttaacctaacgtaaccgttaacctaaaagttaccgtaagttacggacgtacgtacgtaacgtacttacgttcgttaccttccgttactacccgttcctacccgttactacgtacgtgttaaccg

SEQ ID NO: 143199 - DNA, 794 bp, Homo sapiens
  misc_feature: GYAE6OF02I48G9.46.67.G01.1.454.CMB.1.raw
  modified_base (280)..(280): a, c, t, g, unknown or other
  misc_feature (280)..(280): n is a, c, g, or t
tcagactagcagtacacgaccggtgctcgatttagagtatacatattgggtttggggagtctcggtcaggacacagcatggacatgaggtcccgctcagctcctggggctcctgctactctggctcggagtgccagatcgtgacagtcgacgctcgaccctgtaccacctactcctccctggtctcgcgaaccggtgggacacgagtcgtacaccagtctacgtcgaccgggacaaggtcggaacagttacgaccgtaacttaagtttaacgtaggttanactaactagtaccgacgacgggtaccggtacccctaaagtccgtaacctaacgtctaagtccgtacggactacctaacgtaccgtagtttcggaaccgtacgggttacgggccctaaacgtcggtaccggtttagacgggttacgaccggtagttaccggggataccggttaggggtaaactacgttacggtttaccgaacctttcgtaccgtaaccgtattaacgtaacgtacgtaccgttacgaacggtaacggttagttaaacgtttacgttaacggttaaccttaagttaccgttaagttaaccgtaacgttaacgttaacttaacgttaacgttacgggttaaccgtaaccgtaaacgggtacctaacgttaaacgtaaacggtaaaactttaaaccggtaacgtacgtacgtaaccgtcgtaaccgtaacggtaccgttaggttaccctaacgttaccgttaccttaacccgggtcttacccgaggttacccttaggtacctttacgg

SEQ ID NO: 143200 - DNA, 595 bp, Homo sapiens
  misc_feature: GYAE6OF02HI87G.46.67.G01.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccgggacaaggtcggaacngttacgactaccttatttaaagttggtaatacaacatacgaccgagggaccgccctaagcctactaatctatgctgctactcctagtttcgacgtaaggtcgggtaccaggtcgtaggttcgaggtggacgaggtaggatcggtagggactagttacgtttacacttctacacctatacctaagttactcgtacacgtaacgtagtaacttagtttacgacttaactttatacgtataacaacgtaatattaactagttcgttacgacgaaggacctaacgtaactaaacgtaaacttaacgaagtcgtagactacgacctacctagtctcttacttctactccgtacctcctactcgtatac

SEQ ID NO: 143201 - DNA, 652 bp, Homo sapiens
  misc_feature: GYAE6OF02JX2F9.46.67.G01.1.454.CMB.1.raw
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (485)..(485): a, c, t, g, unknown or other
  misc_feature (485)..(485): n is a, c, g, or t
  modified_base (608)..(608): a, c, t, g, unknown or other
  misc_feature (608)..(608): n is a, c, g, or t
tcagactagcagtacacgaccggtgctcgatttagagtatacatattgggtttgtccgtcctgctggtggcagctcccagatgggtcctgtccctggtgcaactgcaggagtcgggcccacgactggtagaggccttcggagccctgtccctcacctgcgctgtctctggtcgcctccatccagtagtggtttcttcgtgggtcgtgggtcccgcgagcctcccgaggggaacgggctggaactacgagttggaacgttgtcctgtactaagttggtagtacggttccttaagtanacgttccgtctcttacgaagtgttcggatacctaccaattctcgnttacgggacctacgtccagacagttactaccgtttcccgaagagtaagtctacgttctggtacaacccggctgtaacgccggtaacgtttgtttaactacgttggccgttagaacggtgaacggtactttagtattacgggttntttagggtaccgtagttttacgactactcctaggaaccgtggaccgggtactccggtacccgttacggggcgtaagtacctcggttcgaccgtacctcgtacttcgccttacacgggtaaccncgtacgttcgtccctacgccgtcaaccctcgactacgcctaccg

SEQ ID NO: 143202 - DNA, 672 bp, Homo sapiens
  misc_feature: GYAE6OF02FRCP5.46.67.G01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (382)..(382): a, c, t, g, unknown or other
  misc_feature (382)..(382): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcacgctcccgaggggaagggctaggaatacagttggaagtgtcctctcagtagtggnggttcctattacngtccgtctctcaagagtcgagtcaacccatatctctggaccacgtccagctaatcctacgttttccctagaacgatgacgttctggtccgaccgcgctgacncgggtctttatacgtgtgacgagagacggacttagtagttagttagtttttgggaggtttggttagtttccgtaacctacccgtagtacgttaccgggacggggtcctaccggtacccggtcggggacccgtaaggggtaacttacggtacggttaccgtaccgttaccgttacccgttacgtacccgtccgaaccccgtaacgggtacccctaacggttcccggttacccgttccccccggtcggtacccctaccccgttccctaccggtaacggtaccgtaaccccgg

SEQ ID NO: 143203 - DNA, 728 bp, Homo sapiens
  misc_feature: GYAE6OF02IWTCZ.46.67.G01.1.454.CMB.1.raw
  modified_base (165)..(165): a, c, t, g, unknown or other
  misc_feature (165)..(165): n is a, c, g, or t
tcagactagcagtacacgaccggtgctcgatttagagtatacatattgggggtttggggagtctcggtcaggacacagcgatggacatgagggtccccgcgtcagctcctggggctcctcgctactctggctcgaggtgccagactgtgacatcgagctcgaccngtcctccactcctccctgtctagacgaccgtggacacagtgtccacatctacttcggccggacaaggtacggaactatacgactaccttaattaagttggtaactacgaactatacgaaccgacgggaccgacccctaagccttacctaatcgtaagtcgtctcgtacactcgtaagttcgaacgtaacgggttccggtaccctaggttaccggttacggtcgtacggtcggacgttacgggtaggtaccgttacggtaggggtaacctaggttaaccgttacccacgtacctacccgaactacgttacgtaagttaccgtacgtacggtaaccgttaaccggtagttaacggtttacgtttaacgtaaccgtttaacttagttaaccgttagtaacctaaacgtaagttaaacgtttacgacgtttaacggttaccgaacggaacggtactaaccggtaactaaacgttaaacgtacgtaacgttcggtaacgcgtacgaacctaacgttacgtccgtacttaccgtatacccttaccgttaccgataccgtcgtataaccg

SEQ ID NO: 143204 - DNA, 718 bp, Homo sapiens
  misc_feature: GYAE6OF02HOIXW.46.67.G01.1.454.CMB.1.raw
  modified_base (219)..(219): a, c, t, g, unknown or other
  misc_feature (219)..(219): n is a, c, g, or t
  modified_base (493)..(493): a, c, t, g, unknown or other
  misc_feature (493)..(493): n is a, c, g, or t
  modified_base (578)..(578): a, c, t, g, unknown or other
  misc_feature (578)..(578): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtcgggcccacgacgtggtgaggccttcggagacccctgtcccctcacctgcgtcttgtctcctggtcnccttccatcagtagttggtttcttaccgtggggccttggggtccggcacgtccgtcccgaggggtacggggtcgtggtaactacagttgggtaagttcgtctctcaagttaggtagggtacggttccttaagttacgacggttcccgtaccttacctactaacggaggtaccgtacgttaccgaacctaattatccttccgtacggactaccgtaccaacgtacctaattaccgttacgtttttacccagtaaaggtagttacgtacgtttcgnggtttacgacccggtccgtacgtacggacgtaacggggttccttttaagttcgttcggtaggtacgagacggtcgtactttaagngttagtttaggttttacggtgttacgtttcgtttacgacgtaccgtaagtcgtcgggaccgggtactcccggtaacccggcggggactacggtagtccggtacgttccgacccgttccgtaccgttaccgtcccgtaacg

SEQ ID NO: 143205 - DNA, 750 bp, Homo sapiens
  misc_feature: GYAE6OF02IL4RT.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaacgtggganacagtgtcaccatcacttcggccggacaaggtcggaacattcgactaccttaatttaaatggtactacaacataacgaccgagggaccggacccctaagcctacctaatcttatgctggactactccgtagtttacgactaaaagggttcggggtaccctagtacggtacggttcgaggtacggtcgtaggtaggtagttacgtcgggaacgtacgttaacgtttacaccgttcttaccacctaataccgtaagttaacttacgtacgtacgtaaacggtaaggtaattagtttacgtaaccgttaaactttaactttaacgttacgttaacgaaacgttaaagtaaagtttaaacgtaacgtttacgggttttaaccgggtaacggtaaacggaaccgtaacgtaaaccgtaaaccgtttaaaaacgtttaaaaccggtaaattaccggttacggaccgtacgtaaaccgtaacccgttaccgttacgttacgtttaccttaaccttaccgttaccccgtttcccggtaacccttaaccgttcgttaacgttaacccg

SEQ ID NO: 143206 - DNA, 698 bp, Homo sapiens
  misc_feature: GYAE6OF02GKM4D.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtcccctcacctgccgctgtctcgtggtcgcctccatcaggttgttggtttctcgtggggctggggtccgcagcctccgaggggagggctaggaatacagttggaagtgtctctcagtaggtggtacggttccttaagttaccgtacggttcccgtcttcctacgtaacggtacgtcgacgtacctaaccattacgttctctaggacctaccgttaccacgactaacttaccgttacgtttttacccaggtaagtacgttacggttacgtttcgtcggtaccggaccccgtcccgtcgtacggtaccggtaccgggttcttttaacttcgttggtcgtacggagtacggtcggtatttagttacgttggtttaggttttaggtacggttaggtttactttaccgaccttaccgtagtacgtcgggtaccgggtcctaccggcccggtagggacccgtaagggtacgtacggtcggtaccgtaccggttcctaccggttacgccctaacccgg

SEQ ID NO: 143207 - DNA, 722 bp, Homo sapiens
  misc_feature: GYAE6OF02I68JY.46.67.G01.1.454.CMB.1.raw
  modified_base (233)..(233): a, c, t, g, unknown or other
  misc_feature (233)..(233): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgcaaccggtgggagacagtgtcaccatcacgttggccggacaagtacggaactnttgacctaccttaatttaacttggtatcgaactataagaccgagggaccggtacccctaagcctacctaagtctatcgcctgacctacttccgtagtttgacgtaacggtcgggtaccctagtccggtaggtctaggtacggtactaggtacgacgttcggtaggacgtattacgtttaccactccgtaccaccgtacgtacgtaagttaaccgtactacgtaaccgtaaagtacggtaaacgttaactttacggaccttaaacttttacgttaacgttaacgttacaaaacgttacgttaaactttaacgttaagtttacggtttaccggtaaccggtaaggtaaccctaaacggtaactaaacgttaaaacgttaaaccggtacgttacgtcggtacgttacgacccttaaccgtacttaccttacgtttaccctaccgttacgttcccccttaccggttaccctacggtttaccgtaggttaaccc

SEQ ID NO: 143208 - DNA, 1065 bp, Homo sapiens
  misc_feature: GYAE6OF02I219M.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtcccgtggtgcaactgcaggagtccgggcccacgacgtgggtgacggtccgttacgggacgtacccttcggtccccctgacccgtggccgtcgttcggttctccgttgggtccgtaccccttccgaattaccgtaaggtttacggtttcgggtttttacccgtttccgggtcggggggttccggttacggggggttccccggtacgaccgggtacccctaccccgggggaaagggggggtaaacgggggtccttacggggtaaaccttaacgttaacggtttaaggggaacggtttcgtcccgtttaccgtacctaaagggtttacggggttacgggggtttaaacccggttttcccctttaaaacttttaaccggtacccggggttttccccggtttacctttaaccggttaaccctaaaggggttaaacggttttccccggggtaagttaaacccccctaaccttaagttttacccgtacccgttttaccggtaaacgggggtaaacccccttaccgggttacccgaaacgttacccgttaaaaacctttccggtttttaccccggtttttaaaccccgtaggttaaaaagggttcgttttacgggtaacccggttttcgtttaacccgggtaaccgtcccccgggtcccgggttaacctaccgggttaaaccggggttacccgggtttaacgttttacgttacccggtttagggttaccggacggttaacgggttaccggtacgttacccgtttaagttttaacggtttagttaccggtttttagggttacgttttaggtttaacgttacccgtaaccgtaccgtacggtaaccgttcggggtaccggtaccgtcccggtaaccgggtcggtaccggtaacgtagtaccggtacgtaccgtcccgttaccgtccgttacctaccgtaccccgg

SEQ ID NO: 143209 - DNA, 1005 bp, Homo sapiens
  misc_feature: GYAE6OF02HL711.46.67.G01.1.454.CMB.1.raw
  modified_base (177)..(177): a, c, t, g, unknown or other
  misc_feature (177)..(177): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgacggccttcggagaccccgtgtccctcaccgtgcgctgtctctggtcnccgtccatcgtagtagttcggtttcttcgtggggcgttcgggtaccgcgtacgccgtcccggagggacggggcgtaggtaacgtaactagttacggtaaagttcggttcctacctcgaagtttacggtcgggttaacgggttcctttaacgttacgtacggttccgtccgtaccttacgaaagtcgtacggtacggttaccaacccgttagttaaccttccgttaccgtagggtaaccctacccggtaccgtaaggacctaaacgttccgtttaccgtttttaccccgaaggtaaggtaacgtttacgttacgttacgttcgtaccgggtacccgtccggtacggtacggaaccgggtacgggtttaccgttttagtttacggttacggtttacggtacggtacggtaacgggtaccggttaacgtttacgttaaggtttaacggttttcggttttaaaggggtttacggtttaccgggttttttaacgtacccgttaaacccgttacccgggttaaacgttacccggggtaaccgggtaacccgggggttcccggtttaaccccgggtaaccccggggtacccggggttaaacccggttaacggggttaaacccgttttaaccgggttaccgggttacccgtttacccggttaacccgtttaccgttacccggttacccgttaaccccgtaacccgggggttaacccgggtcccccttaaccgggttttaccccggttacccccggtttcccccccggttaacgaccccccgttaacccccggtttccccggtaaaaccggtaccggtttaaccccgtaaccccggg

SEQ ID NO: 143210 - DNA, 848 bp, Homo sapiens
  misc_feature: GYAE6OF02H51HW.46.67.G01.1.454.CMB.1.raw
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtcctggtgcaactgcgaggaggtccgggcccaacggactgggtagacggtcccttcgggacgtaccccgtggtccccctaccaccctggcgtccttgtccttctgggtcncccttaccatccgaaggttaggtttcggtttcttacggtggggtccgttcggggtccgganaccgtccgtacccggaggggacggggacgtaggaaacttacgtagttacggtaaggtcgttcctccgttacgaagttaagggttcgggttaacgtttacccgttaaacgttaacgtaccggtccttaccgttcgtaacgtaaggtacggtacgtacggttaaccaccgtaacttacgtccgttacgtacggtaaccgtaccgttcccgaagaccgtaaacgttcgttaaccgtttttacccgaaggttaaacgtacgttacgttacgtttacgttacggtaccggtaccccggtctaccggtaccggtaacggttaccgggtttcgttttaacgttcgttaggttacggacgtagggtacgtacgtacgttaagttgttacggtttaggtttcggtacggtttagtttaccgttacgaaaccgtacgtcgtaacggtaccgggtccgggtacccgtacccgggacccggttgggaccggtaaacggttacgttccggtcggttaccgttcccggtttaccttacccggttaccgtaccctaaccccggg

SEQ ID NO: 143211 - DNA, 732 bp, Homo sapiens
  misc_feature: GYAE6OF02I40KO.46.67.G01.1.454.CMB.1.raw
  modified_base (427)..(427): a, c, t, g, unknown or other
  misc_feature (427)..(427): n is a, c, g, or t
  modified_base (726)..(726): a, c, t, g, unknown or other
  misc_feature (726)..(726): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtcctccatccctccctgtctgcaaccggtgggagactagtgtaccaccatcacgttcggcccgggactaacggtcgggaaactagttcgaacctaccttaattttaaacgttggtaacttaccaaactaattacggaacccgagggaccggaccccctaaggcctaccgtaatctaattcggtctcgactaactcccgtaaggtttgaacgtaaagggtcggggtacccctagtccggtaggttcgtaaggtggcgtaaggtggngttcggacgggtactaacgttattcccgtaaccttcgtaacctaaccgtactaactaaggttaacttcgtacgtaaccgtaaaggtaggtaagtttacgttacggtaactttaacgtttacttaaccttacgtaactaaacgtaacttaaactttacgtaaagtttccgggtttaaccggaccgtaaacgggtaactaccgtaaacgttaaacttaaaacggttaaacgtacgtaggtcgtacctaggtaccaaccgtactacgtacttctacttcttacccgtcctactacgttactnttaacg

SEQ ID NO: 143212 - DNA, 766 bp, Homo sapiens
  misc_feature: GYAE6OF02HN138.46.67.G01.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (256)..(256): a, c, t, g, unknown or other
  misc_feature (256)..(256): n is a, c, g, or t
  modified_base (408)..(408): a, c, t, g, unknown or other
  misc_feature (408)..(408): n is a, c, g, or t
  modified_base (531)..(531): a, c, t, g, unknown or other
  misc_feature (531)..(531): n is a, c, g, or t
tcagactagcagtacacgaccggtgctcgatttagagtatacatattggggtttgtcctcctgctggtggcagctcccagatgggtcctgtccctggtgcaactgcaggagtcgggcccacgactggtgaggccttcggagaccctgtccctcacctgcgctgtctctgtcgcctcatcagtagttggtttctgngggcgttgggccgnagctaccgaggggagggctaggaataacgtagtaggaagttgtcctntcgagtaggtggaggttcctattacgagtcccgttctctagaacgtagtacgacgttacacctaattacgtccttacgtacggaacctccggtaccgaacgactaacgttcgtaaccgtttttccgaagtaagtacgtacgttacggttacngggttacgaccggcccgtactcggtaaccggtacggggttacctttttaaacgttaccgtgggtttaacggccgtaagggacgttaacgggtactttaattacgttggtttaagttttcgggngtttaggttaccttacgaaccgtaccgtagtacggtcgggtaccggggtacctcccgggtaccgggtaccgggaccgtaacggggtacttacggtaccgggttaccctacccgttccgttaaccttccgtaccctaccggtaaccccggtaacgggccccgttaaggtcccgttacccccgttccccggtacggtccccctacccgttacccgaaccgaccggtccgtaccccgg

SEQ ID NO: 143213 - DNA, 794 bp, Homo sapiens
  misc_feature: GYAE6OF02I7L4G.46.67.G01.1.454.CMB.1.raw
tcagactagcagtacacgaccggtgctcgatttagagtatacatattgggtttggggagtctcggtcaggacacagcagtggacatgagggtccccgctcagctccgtggggctcctgctactctggctccgaggtgccgagatgtgacatcgagctacgacccagtcctccacttcccgtccctgtctacgacgtaccggtgggagacagtcgtaccaccgactcgtacgttcgggaccggacacggtacggactacgttacgactaaccttaagtttaaacgttcgaactactaacacgtacgaccgcgggtaaccgacccctagaccttactaattctacgtgccgttagaccttacgtaccgttaggtacgaacgtacggggtaccggtcctagtaccgtaggtacgacgtcggacgtacggtgtacgtacggtaggactaacgtttcttacctacgtacccgtacctaacgagtttacgtaaaccggtcttccgtaacgaacgttaacggttacgtaacgtttacttaacggtaaccttaattaccggttcgtaacgtaactaacgttaacgttactttaattacggtttaaccgggttaccgaaaccgggtaacgtaacgtaaacctaaacgtttaaaccgttaaacccgttaaaggttacccgtttacgaaggttcccgttaaaccggtaacttccccggttaaattttacccgggttacctttaccgtttaaaccccgtccggtttaacccttaccgtaccgttaacctaccgggttacttacccg

SEQ ID NO: 143214 - DNA, 870 bp, Homo sapiens
  misc_feature: GYAE6OF02IKITM.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctcgaggtgccagatgtagacatcgagctacgacccagtcctaccactccctcccttgtctaggaccgtaaccgggtgggaacgacgtacggtcgtaccaacctagtaccgtacggttcggacccgggagtaaacgggtaccgggtaaacctagtttacgaaccttaaccgtttaaagttttaaaagtcggttaactacctaaacaacgttaacggaaccggtacgggtaacccggtaccccgttaaaggtccttaacccgttaataccgttacgttaccgtacgtacggtacctagttacccgtaagtttcgaacggtaaacgggttccggtaccacggttcgtaggttacaggtaggcgtaagggtcgacggttacggtacggtaacttacggtaacgttcctaacgttcctaaccgtacgtacgtacgtaacgttactaccggtacgtaaccggtaagttaacggttaagtttacgtttaaccgtaacttaacgtttaacggttacctaacggttaactaacggtaaacttaacgttaacgtaacgggttttcggtaaccggaaacgtaaaccggtaccggtaaacttaacccgtaaaagttaaaccgttaaacggtacgtacgggttacgtaccctaccggtaaccctaaggtttaccgcgttttaacccggtactttaacccgtacccggttttaaccctcccggttaaacgttcccgttacggtacccttaaaccggg

SEQ ID NO: 143215 - DNA, 789 bp, Homo sapiens
  misc_feature: GYAE6OF02HJ8O5.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtccgttcgggcgaccctgtccctcacctgcgctgtctcgtggtacgcctccatcgtagttggttcggttttcttcggtgggggtcgtggggttccggcgacggtccgtacccggaggggaacggggtcgtagggtaactacgtagttggaagtcgttctctcgagttaggtggtcggttccttacttactacggtccgtccttcgtacgaagtacgtcgacgtacctacctagttactacttcgacggtactaccgtaccgagtactaacttcgttaaccttttcccgaagtaaacgtagttacgttactttacggttcggtaccggcccggtccgtacggtacgtaaccgggtaccgggtttacgtttaaggtttacgtcggttacggtacggacggtaacggacgggttactttaaggtttaacgttggttttttaaggttttcgggttaagggtttaggtttttaaccgtaccggttaaacctaacccggttaggttaaccgggttcccggggtacggttacccggttcccgggtaacccgggtcgggtaacggaacgggttaccgttaccgtcggtacccgtacggttcctaccggttacctacccgtacccgg

SEQ ID NO: 143216 - DNA, 787 bp, Homo sapiens
  misc_feature: GYAE6OF02GR8LM.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgaccaaccgcgganacagtgtccacatcacgttcggccgggacaaggtacggaactacgttacgaacctaccttaatttaaacgttggttaactaccgaaactacgtaacggaccgacggggacccggacccctaaaggccttaccgtaactacgtaagtcgtctagacctacgttccgtaggtttacgacgtaaagggtccgggtaccctaagtccggtaggttactagggtcggacgtagggttacggacttaggtacgggacgtagttacgtttaccgaccttccgtacctaaccgtaactacgtaacgtacttacgtacgtaacggtaaaacgttacggtaaagtttaccgttttacgaacgtttaaacctttacgtttacgtacggtaacctaaacgtaaccgttaaacgtttacgttaacgttttacgggtttaacccggtaaaccggaaacgggtacccttaaacgggtaacccttaaaacggttaaaattaacccggtaagttacgggtacgtaccgtacgaacccgttaacgactttacgtacggtttaccctcgtaaccgttccccgttaccgaccctaagttccttaagttaccg

SEQ ID NO: 143217 - DNA, 621 bp, Homo sapiens
  misc_feature: GYAE6OF02FIAK9.46.67.G01.1.454.CMB.1.raw
  modified_base (197)..(197): a, c, t, g, unknown or other
  misc_feature (197)..(197): n is a, c, g, or t
  modified_base (266)..(266): a, c, t, g, unknown or other
  misc_feature (266)..(266): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgccaaccggtggganacagtcgtcaccatccacgttcgccgggacaacggtacggaacagttgactaccttaatttaatggtanacaacatacgaccgagggaccgcccctaagcctacctaatcagtcgactgcactcctagtttgacgaaggttcgggtaccagtcggtaggttacaggtgctagtggtactcgtagggactagtccttacactttacactaccatacaagttaatctacgaccgtaacgtagttaacttatttacgtacttaacgttactttactacgtactaactagtaaaccttaactatttacggtttaccgaacgtaacggtactaacgtaacttaaaccgtaaaattaaacgattagggtacgtactacgacctactcttcgtactttcgtacttactcccgttaccactcttctataacg

SEQ ID NO: 143218 - DNA, 628 bp, Homo sapiens
  misc_feature: GYAE6OF02G099H.46.67.G01.1.454.CMB.1.raw
  modified_base (218)..(218): a, c, t, g, unknown or other
  misc_feature (218)..(218): n is a, c, g, or t
  modified_base (397)..(397): a, c, t, g, unknown or other
  misc_feature (397)..(397): n is a, c, g, or t
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgcccgggnaaggtcggaacattgacacctatttaaattgtatcaacatagaccagggacggccccctaagctcctaatctatgctgcactcagtttgactaaacggtgggtacccattcggaggttcaggtggcaggtggatcgtgggactagtagtttccacgttctccacctatcgtaagtactntacgactaaaccgttgaaacgttnttttacgacctaactttacttacttcgttacaaactaggtaaacttaaccgtaagttcggttttaccggaccgtaaacgggtacctaacggtaacctaaactaaaacgttaaacgtaacgttggtacgtactacggtaccctaacgtacttacgtcttaccgttacttactttcccttacccgtacccgtactttacgtacgttacg

SEQ ID NO: 143219 - DNA, 715 bp, Homo sapiens
  misc_feature: GYAE6OF02GP1NA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtaccaccatcacgttggccgggacaaggtcggaaactagttcgaacctaaccttaattttaaacgttggtatacgaacagtacgaccgagggaccggacccctaagcctacctaatctagtgctgctactccgtagtttcgactaaggtcgggtacccagtcgtaggttcgaggtggactaggtcggtatcgtagggactacggtactttacgacttccgtacctaaccgtactaacgtaacgttaactccgtagaccgtaaacggtaggtaaagtttacgttttacgacctttaaactttacgttaacgttacgtaaccgtaaacgttactaaactttaactaaggtttaccggttttaccgggaaccgttaacgggaacctaaccggtaaccttaaaacgttaaaacgttaaaccgtaacggttagtaccggtactacgtacccgtaactaccgttcgttaccgttacttacctaccttcccggttaccctaccgttacgttacgtacgttaccg

SEQ ID NO: 143220 - DNA, 671 bp, Homo sapiens
  misc_feature: GYAE6OF02F87N9.46.67.G01.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (637)..(637): a, c, t, g, unknown or other
  misc_feature (637)..(637): n is a, c, g, or t
tcagactagcagtacacgaccggtgctcgatttagagtatacatattggggtttggggagtctcggtcaggacacagcatggacatgagggtccccgctcagctccgtggggctcctgctactctggctccggaggtgccagatgtgacatcgagctcgacccagtcctccactccctcctgtctgccgacggtgganacgtagtgccaccntcacgttcggcggactacgtacggactnttcgacctacttaatttaagttggtactcaaactagtaacgaaccgacggggacccgacccctaagtcctactaacgtctatcgcttgctacttccgtagtttcgaacggtaacgggttccggactacggttacggtaggttacgtacgggtcggaacggttacggtcggtaacgtcgggtacgggtaatacgttaccgttactacgtcctaaccatcgtactaggtacttcgagtaccgtaagtagtaatttcgttaactacttaacttcgtagtactaatacgttactaagtttacctagtttcgggttaccacgtaagggtactaaccgtaaagttaacgttaaactaacgtaggccgttagtcctacggaccttacggttacccttcgtttancccgtcgttacccttccagttcctacgcgttacg

SEQ ID NO: 143221 - DNA, 859 bp, Homo sapiens
  misc_feature: GYAE6OF02H06AE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgccaccggtgggagacgagtcgtaccacctactactacgttcggacccgggacgtaacggtaccggaactagttacggaacctaacctttaatttaaaagttcggttaactaaccaaacgaacgtaaccggaacccggtaacgggggaccccggtacccccttaaggtaccttacccttaattaacctagtcggtaccttacggtaccgaacgtttaccgttaggtttacggaaccggttaaacggggttccggggttaaccccctaaggttaccgggtaacggggtttacggtaacgggtttaggggaccgttaagggggttcggttaaacggttccggggttacggggaaactttaaggttaacccttttaccgaacccgtttccctaacccgtaacctaaccgtacggtttaaacgttaaccttcgtaccggtaaaccttaacggttaaggttaacgtttactttaacgtaaccgtttaatttaccgtttaacgtactaaccgtaaactaaagttaacttaaacgtacggtttacgtttaaccggaacggtacggaacctaaacggtaactaaacgtaaaacgttaacgtacgttagtaccggtacgacgtaccctaacgtacttacttacgttacctactcccgtttcccaccgttaccgtacttagtacgttac

SEQ ID NO: 143222 - DNA, 874 bp, Homo sapiens
  misc_feature: GYAE6OF02FVRZ0.46.67.G01.1.454.CMB.1.raw
  modified_base (231)..(231): a, c, t, g, unknown or other
  misc_feature (231)..(231): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtcctccatccctcccgtgtctcgacaaccggtgggaagacgagttcgtacaccatccacttgccggganaaggtacggaactattcgacaccttaatttaagttggtatacaacatacgacacgggaccgacccctaagcctacctatctatgcttagcatcctaggtttacgactaacgggtcgggtaccctacgtcgtaacgttcgaggttggcgtaagggtggtacttcggtagggaactacggttacgtttacgtaccttaccgttaccctaaccgttaactacccgtaaggtttaaccttacccgtaaggtacccgtaaaacgggtttacggtaaaagttttaaccgtttttacggtaaacccttaaacgttttaacctttaacgtttaaccgtaacccgtaaaacgttaaacgttaaaccgtttaacttaaaccgggttttacggtttttacccggaaacccggttaacgggtaaacccgttaaaccgaaaccgttttaaaacccggttaaaaaacgtttaaaaccccggttaaacggttacggggttaaccggttacccgttaaccgggtaaccccgtaaacccgtttaacggtttaccccgttacccgggtttttaccctaacccggtttttacccgtttcccccccggtttaaaccccgttaaccccggttttaatttaccccggttacggttaaaaccccgg

SEQ ID NO: 143223 - DNA, 750 bp, Homo sapiens
  misc_feature: GYAE6OF02JAGGF.46.67.G01.1.454.CMB.1.raw
  modified_base (154)..(154): a, c, t, g, unknown or other
  misc_feature (154)..(154): n is a, c, g, or t
  modified_base (472)..(472): a, c, t, g, unknown or other
  misc_feature (472)..(472): n is a, c, g, or t
tcagactagcagtacacgaccggtgctcgatttagagtatacatattgggtttgggggagtctcggtcaggacacagcatggacatgagggtccccgctcagctccgtggggctcctgctactctggctccgaggtgccagatgtgacatcganctcgacccagtctccatccctcctgtctgacctaaccggtgggacacgagtcgtaccaccgactcacgttcgggacccgggactaaacgggtaccggaactattcggaactaaccttaagttttaaagttcggttactacgtaaactagtaacgaaccggtacggggaccggtaacccccgtaagtaccttaccttaatccttagtcgtcctcgcctatacccgtagtttacgacgtaaacgggttccggggtacctagtaccggtagttacggaggttcggacgtaggtgtacgttcgacgggactaggtacttacncttacctaccactaacttcgtaaagttagtacctacgaaccgtaaggtacgttaaagttcttttacggtaacctttaaactttacgtttaacttcgtaaccgtaaacgtaacttaaaacgttacgtttaacgtttacggttaccggaaccggtaacggtaacctaacgtaaccttaaataaacgtaacgtaaccgtgggtaccgttactacgaccgtaactcgttacgttcttactaccttaccgttcgttacccctagtttactaccgtagttaacc

SEQ ID NO: 143224 - DNA, 948 bp, Homo sapiens
  misc_feature: GYAE6OF02HZ243.46.67.G01.1.454.CMB.1.raw
tcagactagcagtacacgaccggtgctcgatttagagtatacatattgggtttgtcctctgctggtggcagctcccagatcgggtcctgtccctggtgcaactgcaggacgtcgggccctacgactggtgaggtccttcggacgaccctgtccctacaccgtgccgctgtcctgtcggtacgcctaccagtcgaagttggttcggtttccttcggtacggggtcgtggggtccgactagcccgtaccgggagggtacggggtctaggaactcgtagttacggaaggttcttcctctactaggttaggtaggtaccgttaccttagttacgcgttccgtctccgtagaagttacgtacggacgtacctacctaagttcttccgttacgtacggtaccgaccgtaccgacgtacctaatttaccgttaccggttttaccaaggtaaacgtacggttcgtaacgttccgttacgtaaccggtcccgtaccgtaccggttaacggtacccgggttaaccggttttaaccgttttaattacccggttggtacgggtacggtaacgtacggtaaccgttaccgttttacggtttaagttgggtttttacgtttacgggttaacgggtttaggtttttaacgttaaccggttaaccgttaccggttacggttaaccgggttccggggtaaacccgggggttccctaccccggggttaccccggggtaacggggttaccccgggtaaacggttaaccggttaacccgggtttccgggttaacccgtaccgtttaccccggttaccttaacccgggtaccccaacccggttaacccgggtaaccgggttccccgtaaccggggtttcccccttcccccgggtttaaccccgtccccgggttaccccttaaccccccgttaccgtaacccggtttaacccggcccccgttaaccccgg

SEQ ID NO: 143225 - DNA, 806 bp, Homo sapiens
  misc_feature: GYAE6OF02JY403.46.67.G01.1.454.CMB.1.raw
  modified_base (161)..(161): a, c, t, g, unknown or other
  misc_feature (161)..(161): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgacggccttacgggagaccctgtcccctactcgngcgtctcgtctcggttcggcctccctactacctagtaggtttggtttcgtttccgttgggtcgggttcggtaccggggtccgacgacgtcccgtacgggaaaggggtccggtgacggtatagtaggtaggagttcgtactctagaggtacggtagggttccgttacttactacggtaccgtccgttntaccctaaggaacgtacgtggtactaacctaactgtacctctaacggtcgtaccggtacctggactaacgtaaccggtccgtttttaccttaacggaaggaaagttcgtacggttacctttggtaccggacgccgtaccgttgaacggtaccggggtttacgtttaacttcgtacgtggtaacgcggtaaggtacggtacggttacttagttacgtaggtttaggtttacgggttaggttacgtttacgtaccgtaacgtacgtaggttacggtacggggtccggtaccgtcccggtaaccggggtcggaacggtaggttaaccggtcggttaactaaccggttcctaccggttaccgttacctacccgtacgtaccggtaccgttaccggtccgttacccgttccccgtcggtacccgtacccgtacccgttccgtaaccgacgggtaccctaccgg

SEQ ID NO: 143226 - DNA, 638 bp, Homo sapiens
  misc_feature: GYAE6OF02GQWKI.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttgtttcttcgtggggctgggtccggcagcctccgaggggagggcgtaggaactacagttggaagtcgtctctcatagtggtacggttcctattacgagtccgtctctacagtagtcgagtcacctagtactctcgtcggactcgtaccagctaattcgtacgttttcccagagatgtacgttctgtacgccgcgtctcgacgtcgggtactttacgtactggtgcgaggagtacgtctagttactggtttagttttaggtagtttaggtttacttttaccggaaccttaccgtaaggtacgtccggggaccgggggtcctacccgggtccccggttacggggaccgtaaggggtaactaccggttacggtcccgttacccgttcccgtaccgttccggacccttaccccggg

SEQ ID NO: 143227 - DNA, 780 bp, Homo sapiens
  misc_feature: GYAE6OF02HA3ME.46.67.G01.1.454.CMB.1.raw
  modified_base (272)..(272): a, c, t, g, unknown or other
  misc_feature (272)..(272): n is a, c, g, or t
  modified_base (411)..(411): a, c, t, g, unknown or other
  misc_feature (411)..(411): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctcatcagtagtggttcttcgtggggctgggtccgcagctccgagggagggctggatacagtaggagtgtctctcagtagtggacggtttcctattacngttaccgtctctcgaagtacgtacgacgtccacctagtatctcgtggaaccaccgtccagactaagttccttacgttttaccccgagtaagtattggagtttcgtagtccgacccggcgtctaggtaaccgacgggttnttttaacgtacgtggtacggtacgacgtacggaccggtacttaagttacgttgtttaagttttcggggtaggtttacggtttaacgtttacccggtaaacctacccgtttaaggacgttacgggggtccggggtaacccttcccgggtaacccccgggtacggggtccggtaaacggggtaaacttcccgggttcgggttacccgtacccggtttaccgttaccccgttttaacggcccccgttaacccgaaacccgggtaccgggtacccccttaagggttccccccggtttacccggtttaccccccggtaccgggtaccccctacccccgtttacccgacccgggttaaaccggccgttaccccgg

SEQ ID NO: 143228 - DNA, 545 bp, Homo sapiens
  misc_feature: GYAE6OF02HWUQV.46.67.G01.1.454.CMB.1.raw
  modified_base (192)..(192): a, c, t, g, unknown or other
  misc_feature (192)..(192): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggcaagtcgaacattgactactatttaaatgtatcaacatagaccagggacgcccctagctcctaatctatgctgcatccagttncaaagtgggtccatcgagttcagtgcngtgatcgtggacagattcactctcactancagtaatctgcaagtcgaatatttgactaagttattactagtacctaaanagtaaattactaattacgttacggaccgtaacggaactaaccgaacttaaactaaacttaaacggtaacttagtagggtcctagaccgacgtatcgttagtcttcgtaacttcctacccgtacctacttacctagttaacc

SEQ ID NO: 143229 - DNA, 699 bp, Homo sapiens
  misc_feature: GYAE6OF02HEE67.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttggccgggacaagtcggaacattcgactaccgttaatttaaattggtaatacaacatagaccagggaccgcccctaagctactaatctatgctgcatacctaggtttgactaaaggtgggtacccagtccggtaggttcagtggctaggtggatcggtagggaactagtactttcaacctctaccaacctataccgtaaagtttactccgttagaacctaacggttaagtaaagtttaactttttaacggttaaaactttacgttttaaccgttacgttaacgaaaccgttaaggtaaactttaaccttaaagtttccggttttaaccgggaaccgtaaacggggtaaccctaacggtaacccttaaaacgttaaaacgtttaaaaccggaacttaacgggtacgtacgtacggacctaacccgtataccgttcgttacctacgttaccgttaccccgttacccgaccgtactttacgtacgtactaccgg

SEQ ID NO: 143230 - DNA, 678 bp, Homo sapiens
  misc_feature: GYAE6OF02JS6WO.46.67.G01.1.454.CMB.1.raw
  modified_base (141)..(141): a, c, t, g, unknown or other
  misc_feature (141)..(141): n is a, c, g, or t
  modified_base (187)..(187): a, c, t, g, unknown or other
  misc_feature (187)..(187): n is a, c, g, or t
  modified_base (219)..(219): a, c, t, g, unknown or other
  misc_feature (219)..(219): n is a, c, g, or t
  modified_base (503)..(503): a, c, t, g, unknown or other
  misc_feature (503)..(503): n is a, c, g, or t
  modified_base (605)..(605): a, c, t, g, unknown or other
  misc_feature (605)..(605): n is a, c, g, or t
  modified_base (648)..(648): a, c, t, g, unknown or other
  misc_feature (648)..(648): n is a, c, g, or t
tcagactagcagtacacgaccggtgctcgatttagagtatacatattgggtttggggagtctcggtcaggacacagcagtggacatgagggtccccgctcagctccgtgggctcctgctactctggctccgaggtgccagntgtgactagtcgagcctcggacccagtcctccatccctccctgtcngaccaacggtgggacactggtctccaccgtancccgtttagttcgggcccgggaatacgggttaccgaaactgtttaagacccgtaccttaatttaaacgtggtactacggggaactagtaccgacgacggacccgacctaaggtcctacgtaatctagtgctcgactacgtactggggttacacggtaacggtcggtacccagttcgaacggtttgaccggtagtacgtagtagtacttcgtacggacgttcgtaacttccgtactctacctactcgtaagtacgtttagcttagaccgttaacgtataacgttnttaacgtactttaactacttaagactacaacgtataagtactaggtttcgtaaccgtaccggaacgagttaaacctaattaaactaaaacgtactagtacgngtacgtcgtaccattcccgttaagtcctttacaacccgttttnaacccggtccctaaggttcctagattaccg

SEQ ID NO: 143231 - DNA, 680 bp, Homo sapiens
  misc_feature: GYAE6OF02H1VR3.46.67.G01.1.454.CMB.1.raw
  modified_base (317)..(317): a, c, t, g, unknown or other
  misc_feature (317)..(317): n is a, c, g, or t
  modified_base (520)..(520): a, c, t, g, unknown or other
  misc_feature (520)..(520): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtcctccactcctccctgtctgcaaccggtgggagacagtgtccaccatcacgttcggccgggataaggtcggaacagttagaacctaccttaatttaaagttggtatacaacatacgaccgagggaccgaccctaagcctacctaatctatcgntcgcacttcctaggtttacgacgttaaacgggtcgggtaccctagttccggtaaggttcgaggttcggactaggtaggtacgttcggtacggggactacggttactttcaccttctaccactactacgtaagttaactcgttagaacgtaacggtagtaacgttatttacgaacttaacttttaacgtacttacgtacctaanaagttaaacttacgtaacgtttcggtttaaccggaacgtaacggtaccgaacgtaacttaactaaacgtaaacgtaacgttggtacgtacctacggacctaccgtactccttacgttaccttactaccttcccggttaccctactacttcgtaagtaccg

SEQ ID NO: 143232 - DNA, 739 bp, Homo sapiens
  misc_feature: GYAE6OF02GSK89.46.67.G01.1.454.CMB.1.raw
  modified_base (405)..(405): a, c, t, g, unknown or other
  misc_feature (405)..(405): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattggggtttggggagtctcggtcaggacacagcatggacagtgacgggtccccgctcagcctccgtggggctcctgtcctactcgtggtcctccggtaggtcgaccagtatgtcgactacgtcgacgtacctaccgtaccctacgtccctacctccttcccgtccgttcgtaccgacgaccggtacggtaggtactaaccttctaccacctacgtccgtaccggtaccggtacgtaacgtaccgtaacgtaactacgttacctaaccgttaagtttaactaacgtacgtaactaccaacggtaccgtaccggaccgggtaacccggtacctacccgttactaccttacgtactcgttacncggtaccgagttacctacggtacggttacggtacggtaaccggtgtaccgtaagttccgggttagtaccgtgggtaccgtcgtaaggtacgtacggtagtaccgtattcgtaacctctactctaaccgtanccctaagtagtaatccgtagtaacgtagtaacgttacttagtacttaccttaactacgttacactaacgtaactaagttacgtacgttacgttaccgtacgaactaacgtaactacgtaataacgtaacgtacgtactcgtatactacacgttcgtactcgtacttcctccgacttccacttagtaccgttagctcctaggtc

SEQ ID NO: 143233 - DNA, 745 bp, Homo sapiens
  misc_feature: GYAE6OF02H4LSA.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccagacgtggtgacggtccttcggagaccctgtccctcacctgcgctgtctctggtcgcctccatcagtagttgttctcgtgggctgggtccgnagcctcccgagggagggcgtagaactactagttaggtaagtgtctcttcaagttaggtggtacggtttccttaagttacgacgttccgtaccttcgtacgaaaggtacgttaccggtacgtaccgaacctaattacttccgttcgtacgggaccctaccgtaccgaacgactaaacttccgttaacgttttttccccgaagtaacgagtttaggtacgtttcgtcggtcggtacccgtccgtaccgtaaggtaccggtacgggttcgtttacgtttagtcggtggtagtaacggaacggttcgacttagtttatttcggtttagtttttagggtacgggttttaggttacgttttaacccgaccttaacccggtagttacggttaccggggtaccggggtccctacccggtcccgggtacggggtaccgtaaccgggtacttaccggtcggttaccggtcccgttacccgttctttacccgaccgtaacccccg

SEQ ID NO: 143234 - DNA, 865 bp, Homo sapiens
  misc_feature: GYAE6OF02JFFJI.46.67.G01.1.454.CMB.1.raw
  modified_base (159)..(159): a, c, t, g, unknown or other
  misc_feature (159)..(159): n is a, c, g, or t
tcagactagcagtacacgaccggtgctcgatttagagtatacatattgggtttgtcctcctgctggtggcagctcccagatgggtcctgtccctggtgcaactgcaggagtcggcccagactggtgaggtccttggacgaccctgtccctcacctgccnctgtctcgtggtcgcctccatcgagtacgttcggtttctacgtgggtcctgggtccgacagtcctccgaggggaacgggtcaggtactacgagtttgggaacttggttacctcgtacgagttacggtaggttacggttacctaacgttaccgtacggttaccggtcttccgtacgtaaggtcgtacggtacggtaccaacgtactatccgttacgacgtacctaccgtcctagaccgtaatccgttacgttttcccgagtaacggtattacgtcggttactttacggtacccgtaccggacccgttcgtaaccgggtaaccgggttcgggtttaacgtttaccttaacggtcgggtaccgtacgggaacgtacggtaccggttacgtaacgtttgtacggtttaagttttggggaacgtttacgggttttaccttacggtaacccgttaaccgttaacgggtacgttacccggggtaaccggggttaccctacccgggtacccgggtaccggggtacgtaaacccggggttacttaaccgggttccgtaacccggttaccgtttacccgtaccgtttaacccgccccgttaaccgtaacccgggtaacccggttacccggttaagttcccccgggtttaacccctccccggttaccgtaccccgttaaccccttcccggaacccggtactaccccggtaacccggg

SEQ ID NO: 143235 - DNA, 771 bp, Homo sapiens
  misc_feature: GYAE6OF02IHESE.46.67.G01.1.454.CMB.1.raw
  modified_base (99)..(99): a, c, t, g, unknown or other
  misc_feature (99)..(99): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
tcagactagcagtacacgaccggtgctcgatttagagtatacatattggggtttgggggagtctcggtcaggacacagcatggacatgagggtccccgntcagctccgtgggggctcctgctactctggctccggaggtgccagatgtgacatcgagctgacccagtcctccatcctcccttgtctgacgaaccgggtggganacngtcgtacaccatcacgttggccgggctaaaggtcgaactagttgacctaaccttaattttaaacgtggtactacaaacagtacgaccgagggacccgaccccgtaagcctcctaatctagtcgctgactactcctaggtttcgacgtaaacgggttccggggtacctaggtacggtacggttacagggtggacgtaggtaggtacgtcggtaggaacgtagttacgtttcctaactccgtaaccctacctatccgtaagttacacgttacgaaccgtaacggtttaggtaacgtttatttacgaaccgtttaactttacgttaccttaacggtaactaaacgttaaacgttaacgtttaactaacggttttacggtttaacccgggtaacggtaaccgggtaaccgtaacgttaaaccgtaaacgtaaaaactttaaacgggaacgtttacggggttcgaccgttaccggtaccgtaacccgttaacgtttcgttaaccggttttctttaacccgtacgttttccccgtttacccggaccttaaccgtttcttaacgggtaaccc

SEQ ID NO: 143236 - DNA, 817 bp, Homo sapiens
  misc_feature: GYAE6OF02JE919.46.67.G01.1.454.CMB.1.raw
  modified_base (234)..(234): a, c, t, g, unknown or other
  misc_feature (234)..(234): n is a, c, g, or t
  modified_base (582)..(582): a, c, t, g, unknown or other
  misc_feature (582)..(582): n is a, c, g, or t
tcagactagcagtacacgaccggtgctcgatttagagtatacatattgggtttggggggacctcctgtgcaagaacatggaagcacctgtggtttgtcctcctgctggtggcagctcccagatgggtcctgtccctggtgcaactgcagggagtccgggccacgactgggtgacggtcctttcgggacgtacccctcgtacccctcacctggccgtctgtccgtcgtcgggtcncccttaccattcagttaggttcgtttcctcggtggggtcgttcggggtccgcacgtccgtaccggaaggggtaacgggtcgtaggaattacgagttacggtaagtcgtcgtacacgtagtacggtacgggtacgttccttaagtacctacggttcccgttcttaccgtacgaaggtacgttaccggaacgttcccgaacctagttacttcctcgtacggacctaccgtaccgagaacctaacgttacgtttaaccgttttccgaaggtaacgtgttacggttaactttcgacggttaccgaccccggtacgtcgtaacggtacccgggttacggtttacggttttacnccgggttaggcggtacgaaaggtccgggtaccgtttatttaaggttacgttacgggttttattttacggggtagtttttacgtttacgttaccgaacccttacgtacggtccgttaccggggaccggggttacctacccgggtaacccgggtcgggtaacggtaacgggtaacggtttccgtaccgggttacgtacccccgttacggttccccttaaccggcccttaaccccggg

SEQ ID NO: 143237 - DNA, 843 bp, Homo sapiens
  misc_feature: GYAE6OF02H7PML.46.67.G01.1.454.CMB.1.raw
tcagactagcagtacacgaccggtgctcgatttagagtatacatattgggtttgggggacctcctgtgcaagaacatgaagcacctgtggttgtcctcctgctggtggcagcctcccagatcgggtcctcgtcccgtggtgaccaacgtgacgaggacggtccgggcccgacgacgtggtagaggtcccgttacggacgtaccctccggtcccctccaccgtcggccgtccttcgtccgttcgtacgggtccgccctacccagttacgtacggttaggtttccggtttcgttcgggtcgggggtccgttacgggggtccggacgtacggtccgtacccggagggggtacggggtcgtaaggtaacgttacgtaggttaggtaacgttgtccttacgtcgtaagttagggtcggtaacgtttccgtataccgtcgtccgtctaccgtacgtagtacggtacgtactacacgtacgtactccgtcgtaacgaccgtcgacgtacgactaccttcgttaactttaccggagtaacgtagttggtacgtttcggacgtacccggtccgtccgtcgtaacggtacggtaccgggtttattacgttaccgtggtaccggtacgaggaaccggttctacttaggttagttaggtttagttcggtaagttacggttacccgtttaccgaaccgtacggttacggtacggttccggggtacccgggtccggttaccccgggcccgggttccggggaaacgtacccggggtttaacctaccggggtttccggtaaccccgtttcccccggtaacggttttccccggtacccgggacccctttaaccccggggg

SEQ ID NO: 143238 - DNA, 762 bp, Homo sapiens
  misc_feature: GYAE6OF02F75LJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctacgacccagtctccactccctccctgtcctgaccgaaccggtgggacacgtagtgtaccacctatcctacgttcggacccgggactaacggtaccggaactattacgacctaacccgtttaatttaaacgttggtaactacaactagtacgaccgacgggaccggacccctagacccttacctaatctatgctgactacttacctagttacgacgtaacggtccgggtacccaggtaccggtacggttcgaacggttcggacgtaggtcggtacgttcggtacgggaacgtagttacctttacctacgttcccgtactaccgttactaacgtaagtttacgtccgtacgtaaccgtaacggttacgtaagtttacgtttacggtaaacccttaacgttttaacgttacgttaacgtaactaacgtaattaacttaaacgttagtttaccggtaaccgaacgtaacgggtaaccctaacggtaaaccttaaacggtaaaacgttaaaccgtacgttacgggtaccgtaccgtacgtacctaaccggtactttccggttcgttaccttacgtaccgtttaccccctacgccgtactttccggattaaccg

SEQ ID NO: 143239 - DNA, 642 bp, Homo sapiens
  misc_feature: GYAE6OF02JCKEW.46.67.G01.1.454.CMB.1.raw
  modified_base (99)..(99): a, c, t, g, unknown or other
  misc_feature (99)..(99): n is a, c, g, or t
  modified_base (210)..(210): a, c, t, g, unknown or other
  misc_feature (210)..(210): n is a, c, g, or t
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttgggggagtctcgggtcaggacacagcatggacatgagggtccccgntcagctcctggggctcctgctactctggctccgaggtgccagatgtgacatcgagctgacccagtctccatccctccctgtctcgcaaccggtgggagacagttgcaaccntcacttgccgggtacaagtccggaacattgaacacctaatttaaactgtatcaactatagaccaggacgcccctaagcctactaatctaatgactgcatcgattgacaagtcgggtcctagcgtaaggtctagtcggntacgtggatgtagggactagtacgttacncgtactccaacgatcgtaagtaactcgtacacgtaacgtaggtaagtacttttagacttaaaccttaattacgtacttacaaaccgtaagtaaactttataaccgtttggttttaccggaaccgtaacggggtaaccaaccgtaaacgttaaaccgttaaaagttaaacccgaaaacgttccggtaaggcctaggtaacctaacgtagttccgttagtacctttcgaacgttcccttacccgaccttacgttccgtaggttaacc

SEQ ID NO: 143240 - DNA, 876 bp, Homo sapiens
  misc_feature: GYAE6OF02INFBS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccactccctccctgtctcgaccaaccggtgggagacgagtcgtaccaccatccgtacgttcgggaccgggactaacggttaccggaaacctagtttacgaacctaacctttaaacgttttaaaagtttggttaacttacctaaaactaacgttaaccggaacccggtaagggggtaaccccggtaaccccccgttaaaggtacccctttaacccgttaaaacgttacccgttaaagttcgggtacccgttacggtaaccctaccggttaacccgtttaacgggtttttacggaacccgggtaaaaacggggtttcccgggggttaaccccttaaggttacccggttaacggggtttacgtaacgggttcggtacggtagggttaccggtacgttccggttagggaacctacggttactttacccgtaacgtttacccttccgaacctacgtttaccgaagtttaaactcgtaacggtactaaacggttacgttaagttacgttttacgaacttaacgttttaacttacgtaccttacgaaacgttacgttaaattaaccgtagtttacgtttaccggaaccgtaacgggtactaaccgttaactaaacgtaaacgttaaacgacgtcgttacgtctaacgtcccaacgtacttaccgttacgttaccttacgtaccgttacccgttacccaccgttattccgtattacccg

SEQ ID NO: 143241 - DNA, 711 bp, Homo sapiens
  misc_feature: GYAE6OF02JAS5C.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtcccctcaccgtgccgtctgtctctggtcncctccatcagtgttcgtttcctcgtgggctcgggccgcacgtcctacccggagggaacgggtctaggaatacgagttggaagtgtccgtctctagtagtggtacgttcctagttacgacgtccgtcgtctacgaagtacgtccgacgttccaaccgtattactcgtcgtacggacctaccgtaccagactaactccgttacgttttcccagagtacgtgtagtttcgtcgtacgcccggcgtctacgccggtacggttcttatcgtgtcgacggtagtacgtcgtatttagtacgttaggttacgttttaggtacggtttagtttaccgtttaaccgaacccgttacggttacgtaccggttaccggggtaccgggtcccgttacccgggtacccggtaccggggtaccggtaaacggttaaccggttaccgttaccgggtacccgttaacccggtttacccgtccggtttaccccggtacccgtaacccccgg

SEQ ID NO: 143242 - DNA, 684 bp, Homo sapiens
  misc_feature: GYAE6OF02FLYWO.46.67.G01.1.454.CMB.1.raw
  modified_base (236)..(236): a, c, t, g, unknown or other
  misc_feature (236)..(236): n is a, c, g, or t
  modified_base (656)..(656): a, c, t, g, unknown or other
  misc_feature (656)..(656): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtgggacgacagtcgtacaccatcacgttcgccgggacaagtacggaactnttacgacctaaccttaattttaaagtggtatacaaacatacggacacgggaccgcccctaagctactatctatcgctgctataccgtagttagacgtaaaggtcgggtaccagtaccggtagttcaggtggcctaggtcgtatcgtaggacgtagttactacctactacctacgtacctagtcaagttaactcgtacgacgtaacgagtaagttattacgtactaaacgttattaccgtagtaacctaaacgtacgttaaagttaacctagtttaccggtttaccgggaacgaaccgggtaacctaacgtaaccttaaaaccgttaaaagttaaaaccgacgttacgtaacggtactaacgtaaccaacgtaacgttccgttaaccgttcgtttaacctaccggtttacccgtttaaccncccttaacggttaccgttagtaacccgg

SEQ ID NO: 143243 - DNA, 806 bp, Homo sapiens
  misc_feature: GYAE6OF02HGNF9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgacaccgtggagacagtgtacaccatccactttcggaccgggtacaacggttccggaaactactttcggacctaacccttaagtttttaaaattcggttaagtacctaaccagtaacggtaacccgaacggggtaccccggtaccccctaacgccgttaacccttaatcttacgttaggcttggaccctactacccgtagttttacggtaaccgtaaacgggttccgggtccccgtaacgtaccgggtaagggtttaccgagggttcggaccggtaacggtgggacttaccggtggggtaaccgtagttacgtttactaccttccgtaccaccttacgttacgtaaacggttaacgtacctacggtaacgtaaccgttaggtaaagtttcgttttaccacgtttaaacctttactttaacgtattacctaactaagttaactttaactaagttttaccggtttaccggaccgttaaaccgggacttaaacccgaacgtttaaaccgtaaaacgttaaacccggaaacgttacgtacgggtactaggtacgttaaccctaggttaccttccggttactttacccgtaccctttccgttacccccggttcaaccgtttcgtacgttaaccg

SEQ ID NO: 143244 - DNA, 922 bp, Homo sapiens
  misc_feature: GYAE6OF02JWOYC.46.67.G01.1.454.CMB.1.raw
  modified_base (203)..(203): a, c, t, g, unknown or other
  misc_feature (203)..(203): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacgactgggtcgaggccttcgggacgaccctgtccctcacctgccgctgtctcgtggtcgcctcatcagttagtggtttctcgnggggctagggtccggcacgtcgtcccgaggggacggctaggaactacgtagttggacgttcgtctcgtcagtaggtacggtacggttacctattaccgtacggtcccgttctaccgtagaacggtaggttaccggaacgttacccgaaccctaattaccttccgtcggtaacgggttaaccacccggtttaccgaactacccggttaattacccgttaaacggtttttcccccgaaaggtaaacggtacgtttaggtaaccgttttcccgttaagggttcccgaaccccggggtacccttcggtaacggtaacccggtaacggggtttaccgttttaaacgtccggttaggtccggaagtaacggaacggtacccggttacgtttaagttacgttaaggtttagttttagggttacgggttagtttttaacggttacccgaaccgttaacccgttaaggtacccgggttaaacgggtccggggtacccgttaccccgggtaacccggggtccggggtaaccgggtaaacgggttaaacgttcccggttacgggttaacccgttccgggttaacccttaccgttacccggttcccgtaacctaacccggggtaaccgggttacccgttaaccggttcccggttaacccccgttttccccggtacggttaccccccttaccccgttacccggtaacccggttaacggaacccgttacccgg

SEQ ID NO: 143245 - DNA, 898 bp, Homo sapiens
  misc_feature: GYAE6OF02JNDWQ.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctccagatgggtcctgtcctggtgcaactgcaggagtcgggacccacgacgtggtagacggtccgttcggacgaccctcggtccctcacctgcgctcgtctcgtggtcgcctaccatcgtaggttacgttggtttcttcgggtggggtcgttcggggtaccggcgtacgtccgtacccggaagggggtaaacgggggtccgtagggtaaacttacgtaacggtttgggaaaggttcggttacccgttcttaccgtaagttaaggttaggggtaacggtttccgtttaagttaaccgtacggttccgtttcgtaccttaccgtaaaggtacgttacggtacgtaccgtaaccgtataacttcgttacggtacggtaacgacccgtaccgtacgtaataaccttacttaacccgtttttcccgtaaggtaaggtaacgtaggttaacggtttccgttacgggtaccgtaaccccggtcccggtacgtacggtaaccgggtacgggtttagttttaaaccgttcggttacgtttacgggacggtacgggtaagggtaaccggttcgtttacgttaaagtttggtttacggtttttagggaaggttttaacgggttttacgtttacccggtaacccgtaacccgtttaaggtcggttaccggggaccggggtttaccggccccgggttaacccgggtaggggggttaccccgtaaaggggttaccgtacggtttacccgggaccggttacccgttcccggtttacccgttacggttcccgtaacccccgg

SEQ ID NO: 143246 - DNA, 677 bp, Homo sapiens
  misc_feature: GYAE6OF02HT4MA.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcgaaccggtgggacgacagtgtcaccatcaccgttcggccgggacaaggtaccggaactattcgacctaaccttaatttaaattggtatacaacataacgaccgaacgggaccggacccctaagcctacctaatctatgtcgtgctactccgtagttagacgtaaggtccgggtaccagttcggtaaggttcgaggtacggcgtaggttaggtactcggtagggactaagtactttactacttcctactaccctataccgtaagttaacttcgacgtaacgtacgtacgtaaagttacgtttacgaacttaacgttttaattacttacgtaacaaacgttaacttaaacgtttactaaaggtttcggtttaaccgaaccggaagggtaacctaacgtaaactaaacgttaaacgtaacgtaaacgtgtagacttacgactacgtactcgttacgttcttaccgtacttcccgtacccgtactacgtcttacgtacg

SEQ ID NO: 143247 - DNA, 748 bp, Homo sapiens
  misc_feature: GYAE6OF02I97ET.46.67.G01.1.454.CMB.1.raw
  modified_base (229)..(229): a, c, t, g, unknown or other
  misc_feature (229)..(229): n is a, c, g, or t
  modified_base (433)..(433): a, c, t, g, unknown or other
  misc_feature (433)..(433): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgagggcctttacggacgaccctgtcccctcacctgcgctgtctctggtcgcctccatcgagtagttcggttttcttcggtcggggtcgtcggggtcccggnacggtcccgtcccggaaggggacggggtctaggaaactacgtaagttcgggaagttcgtctcgtcagttggtggtacggtttcccttattacgtacgttccgtcttctcgaaggtgtacgtagtacctacgtatcttccgttcgtacggtacccgacgttacccagtactaacgttcgttaccgtttttacccgagttaacgtntagtacgttctcggacgtacccggcgtacgtcgacggtacggttctttagttacgtgtcgcgaggtacgaccgtattagttacttacggtttagtttacggtagtttacggtttacttaccgtaccgtaaccgttgtacggttacggggtccggtaccgtacccggtaccgggtccgggtaaccggaaggtaacgttccgggtacttccgtaccgttcctaccgttccgcccgtaccgaacccggtcggtaccctcgttacccgttcccctccggtcccgtacccgttaccctacccgtacgacgtccgtacccg

SEQ ID NO: 143248 - DNA, 644 bp, Homo sapiens
  misc_feature: GYAE6OF02HV1XY.46.67.G01.1.454.CMB.1.raw
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (439)..(439): a, c, t, g, unknown or other
  misc_feature (439)..(439): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcnctgtctctggtcgcctccatcagtagttgtttcttgtcggggtcgtgggtccggcncgtcctccggaggggaacggggctaggaatactagttcggtaagttgtctctcagttacggtggtacggtttccttaacgttacgacgttccgtctctacgagagtcgagtccactatactctctacgacacgttcagtctactcgttacgtttccagtatatgtacttcgtgagcccgcgtnacgacgtcggttacttttatcgtggtcgtacgagacggtccgtagtactttagcggttttaagttttggtaccggtttatttacgttcgtaaccctacggttaagtccggtacgggacggggtcctacccgggtcccggcgggtacgacggttacaccggttcggtaccgtcccttcggttacccgttccgtaccctaaccccgg

SEQ ID NO: 143249 - DNA, 652 bp, Homo sapiens
  misc_feature: GYAE6OF02FYBDQ.46.67.G01.1.454.CMB.1.raw
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (195)..(195): a, c, t, g, unknown or other
  misc_feature (195)..(195): n is a, c, g, or t
tcagactagcagtacacgaccggtgctcgatttagagtatacatattgggtttggggtagtctcggtcaggacacagcatggacatgagggtccccgctcagcctcctgggctcctgctactctggctccgaggtgccagatcgtgacatcgagctcgacccngtcnccntcctcctgtactgcaacggtggganactagtcgtcaccagttcgtaccttcggccgggacaaggtccggaaatagtcgacctaaccttaatttaaattcggtactacaaccatacgaccgacgggaccgtaccccaaggctacctaatcgtactgtaccgtgcactcgtagttacgactaaggtcgggtaccagtcggtacggtacagtaccggagtaggtggactcggtagggactaggttacttcgacttcgtaccactactactagttaatcgtcagtacgtagtagtatttacacgtattacttacttcgtactaacattaacgttacgtaacgttagtttaccgggactaaccggtaacgacgtaacgtaacgttaaacgtaaacgttaacagggttacgtactaccgacggtaaccctattacggtaccgtttactacgtaccctttcctaccggttccctagttaccctgtaacc

SEQ ID NO: 143250 - DNA, 694 bp, Homo sapiens
  misc_feature: GYAE6OF02FJFVQ.46.67.G01.1.454.CMB.1.raw
  modified_base (323)..(323): a, c, t, g, unknown or other
  misc_feature (323)..(323): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccctttcggagtaccccgtgttcccctcgaccctgccgctgtctctggtgcctccatcagttagtgtttcttcgtgggctgggtccggcagctcccgagggagggctggatacattggaagtgtctctcagtagtggacggttcctatactacgtccgtctctcaacgagtcgagtcaccatatctctcgacncgtcagctatactacgtttttcccgagacgtangtacttntgtcgaccgtcgctgacgacggttctttaattcgtgtcgtacggagtagacggtacttagttagttgttacgtttttaggtagttacgtttaccgtttacggtaccaccgttagtacggtccgggtacggggtcgtacccgtacccggaggggtcccgaacgggtaataccggttacgtacccgtacccggtttacgttacccgttacgtcccgtaacccggtaacccgaacccgggttaccccgtaaccggttcccgttaccccgttttacccccgccggttaaccccgtccccttaccccggtacccgtaaccggtaccgtaaccccgg

SEQ ID NO: 143251 - DNA, 602 bp, Homo sapiens
  misc_feature: GYAE6OF02JH5F2.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctccgtggggctcctgctactctggctcgaggtgccagatgtgacatcgagctgacccagtctccatcctcctgtctgacgaaccggtgganacagtgtcaccatcacttgccgganagtcgatattgactactattaagtggtatacgaacagtagaccagggaccgccctaagccttactaanccttaangtactgacacgtcctagtttacgactaaaggtcgggaccctagtcggaaggttaccagtggactaggtacgtagtcgtaggacagtttaactcgacttactccacgtatacgtattaacncgtatactaacgtgtagttattacgaacttaattattacgtataacgaacgtaattaacgttaactgttacggttacgaccgtaagaactaaccgtaactaaagtaaactaacgtactacgtcgagtgaacccgtctatcgttacgtacctttacgacttaccgttacccgagttactcgtacttaacg

SEQ ID NO: 143252 - DNA, 805 bp, Homo sapiens
  misc_feature: GYAE6OF02HVK5W.46.67.G01.1.454.CMB.1.raw
  modified_base (236)..(236): a, c, t, g, unknown or other
  misc_feature (236)..(236): n is a, c, g, or t
  modified_base (248)..(249): a, c, t, g, unknown or other
  misc_feature (248)..(249): n is a, c, g, or t
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (355)..(355): a, c, t, g, unknown or other
  misc_feature (355)..(355): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtcccttcggacgaccctgtccctcacctgcgctgtctcgtggtcgcctccatcagtgtgttctgngggctggtccgnngctccgngggaggctgatacatggagtgtcgtctnagtacggtggtacgttctagttacacgtccgtctctcgagtagtcgagtcaccattactctcgtacgtacncgtccgaagactaacgttaccgttacggtttttacccaggtaaacgtacgttacgggttacgtttaccgttggtaccggtaccccggtaccgtaccgtttacggaaaccggttaccgggggtttaccgtttttaaaccggtttacgttcgggttaacggtaccgggtaaggtaacgggttaacccggttatttaaccggttttaggtttaacggttttagggtttttacggggtaacggttttaggggttttaacgtttaacccgtaacccgttaaccccggttaaggtacggttacccggggaccgggggggtttacccctacccgggttaacccccggggttaccggggtacccggtaaaggggttaaccgttaccgggttaccggtttacccggtacccggttttccccggttaacccggttaccggttacccccgtaacccccggg

SEQ ID NO: 143253 - DNA, 700 bp, Homo sapiens
  misc_feature: GYAE6OF02IVPXD.46.67.G01.1.454.CMB.1.raw
  modified_base (151)..(151): a, c, t, g, unknown or other
  misc_feature (151)..(151): n is a, c, g, or t
  modified_base (199)..(199): a, c, t, g, unknown or other
  misc_feature (199)..(199): n is a, c, g, or t
tcagactagcagtacacgaccggtgctcgatttagagtatacatattgggtttggggagtctcggtcaggacacagcatggacatgacgggtccccgctccagctccgtggggctcctgctactctcggctccggaggtgccagatgtganatcgagctcgacccagtctaccatcctcctgtctgcaaccggtggganacaggtcgtaccacctatttacgtcggccgggactaacggtacgaactacttagacctaacttaaatttaaacgttgtaactaccaatacgtacgaccggacggtaccgacccaagcctactaactctatcgtctagactacgtacgtagtttcgacgtaacgggtccggtactacgtcggttagtcgacgtcgagttgacggtcgtaggtcggtacgtatacttactacctactacgcattacgtaattctacgtcaacggtactaaggtaacttagttaacgactaacgttttctactaaacgttaccttaagtaacgtttacgttaaacgtacgtttaccgttacggaaccgttaaacgggtaccaacgttaaacctaacgttaaaacgtttaaacgacgtgtcgtaccgtacgtacccgtaacgttcgtttccaacggtttccttaaccgttacttccccgttaaccgtaccgtaactacggtttaacctggttacg

SEQ ID NO: 143254 - DNA, 706 bp, Homo sapiens
  misc_feature: GYAE6OF02HCA46.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacattgacctaccttaatttaaagtggtaatcaacatagaccgagggaccgaccctaagctacctaatctatcgctgcatccgtagtttcgacgtaaaggtcgggtacccagtcggtagttcaggtcgcgtaggtggtagtcgtacgggaactaggttactttacgactttcctaccgtaacctacgttaactaacggttaacttccgttacgaaccggttaaacggttaggtaaaacgtttaagtttttaacgacctttaaaacgttttacgtttaaccgtttacgttaaaccgtaaaacttaaaggttaaacttttaaaccgtaaagttttccggttttaaccggaaccgtaaagggtaccctaacgtaaacttaaacgtaaaacgtttaaacgaactttagggtacgtcgtaccggtactaaccgttattcctacgttcttactaccgttccttcccgattaccttgtacgtaacg

SEQ ID NO: 143255 - DNA, 647 bp, Homo sapiens
  misc_feature: GYAE6OF02JEJ95.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcgagtagtggtttcttcgtggggctgggtccggcagctccgaggggaagggctaggaatacagttggaagtgtctctcatagtggaggttctattacagtccgtctctcaagagtcgagtcacagtatctctggacacgtccagcgaatctagttttcccaggaacgtatagagttctagtcgaaccgtccgcttgacgtacgggtcttttaactacgtgtcgacgagtacgacggtacttaattacgtagttacgtttttaggagtttggtttacgtttacgacctaccgtagtacgtacgggtaccgggcctaccggtacccggtaccgggaccgagggtaacgttaccgttcggtacgtaccgttccgttaccgttaccgtccctaccgaccggaaccgggtccctacggtccggttcccttccccgtcggtaccctaccccgttcccgaccgtacgacgtacccg

SEQ ID NO: 143256 - DNA, 698 bp, Homo sapiens
  misc_feature: GYAE6OF02JZCT1.46.67.G01.1.454.CMB.1.raw
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
  modified_base (328)..(328): a, c, t, g, unknown or other
  misc_feature (328)..(328): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctagacccagtcctccattcctccctgtctgccaaccggtggganacagtcgtacaccatcacttcggccgggtacaaggtacggaacngttcgacctacttagtttaatggtatacaacatacgaaccgtagggaccgtacccgtaagcctacctaacttctaagtgtcttacncgtactacgtacgttagccgtaaacggtcgggttaccctaaggtcggtacggtttacgaggttcggacgtagtcgggtaatcggagggtaacctatacgtttacaaccttcctactacccgtattaccgttaagttactaccgtcgaacgttaaacggtgtaagttacgtttaacggacttaactttaacttacgttacgtaactaaacgttaataaccgttaaactaggtttaccggtttaccaacggtagtaactaaacccgttataaaaccgttaaactaacggtaaacgtcggtacgtacgactaaccgtacctagtttctagttaccttacgtacttccgacccttcggacttccggtattaccg

SEQ ID NO: 143257 - DNA, 851 bp, Homo sapiens
  misc_feature: GYAE6OF02HI5J8.46.67.G01.1.454.CMB.1.raw
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcgaggagtccgggcccacgactggtgaggtccttcggacgacccttcggtaccccttcaccgtggccgaccttgtcctcgtgggtcgccctaccagttcctaggttacgtttcggttttaccctcggtacgggggtcgttcggggtcccggacacggtcctacccgagggggaacggggtntaggaatacagttaggacgttactcgttacncgtaagtacggtcggtaacggttccttaagtacgtacgtcccgttcttactacgtaaacggtcggttacgacggttaccaacctaagttactctttccggaggtaaccaccggttacccgaaataccgtaacgttaccgttaccgtttttccccaaggtaaacgttcgtttaacggttacgttacggttacgtaccggtacccgggtacccgtcgtacgggtaaaccgtacggggtttaccgttttaaacgttcggacgttacgggtagaagttaccgaacgggttattaacggtttagttacggttttaagtttttggaacgtttaggtttaccgtttaacgaccctttaaacggtaaggtaccggtaccgggtaccggggtccgtaacccggtccccgggttacggggaccgttaaaccggggtaacgttacccggttacgggtaacccgttaccccgttaacggtttacccgttacgtacccccggtaacccg

SEQ ID NO: 143258 - DNA, 569 bp, Homo sapiens
  misc_feature: GYAE6OF02I7A16.46.67.G01.1.454.CMB.1.raw
  modified_base (333)..(333): a, c, t, g, unknown or other
  misc_feature (333)..(333): n is a, c, g, or t
  modified_base (428)..(428): a, c, t, g, unknown or other
  misc_feature (428)..(428): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacattgacacctattaattggtatcaacatagaccagggacgcccctaagctctaatctatgctgcatccagtttgacaaaggtcgggtacccagtcgaggttcagtggnagtggtatcgtgggacagtatttacactctacacctactactagtaatcgtagacaacggtagaagtagttttagacctaaagttacttaacgtntacactaagtaaacttacaaagtttgtttaccggacgtaaacgggactaacggtaactaaacgtaaaattaaaccgtaaagtgttagcttacgactaacatctagtcttacctagtccttcccgactacgtactagttacg

SEQ ID NO: 143259 - DNA, 661 bp, Homo sapiens
  misc_feature: GYAE6OF02FKI9V.46.67.G01.1.454.CMB.1.raw
  modified_base (140)..(140): a, c, t, g, unknown or other
  misc_feature (140)..(140): n is a, c, g, or t
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttggggagtctcggtcaggacacagcatggacatgaggtcccgctcagctcctggggctcctgctactctggctccgaggtgccagatntgacatcgagctgacccagtctccatctccctgtctgcaaaccgtggganacagtgtcaccatcacttgccggcaagtcgaacgnttganacctattaatggtatcaacatagaccaggacggccctaagctctanctatgctgctatccngtttagcaaagtggggtcctagtcgagttacgcgtggtacagtggatcgtgggaacctaggattttcgaaccgttntacctaccgactacgtacgttaacgtcttacgtcgtaaccgttgaaacggtaacttttggtacttaaccgttattaacgttcgttaactaaacacggtaaatttaacgtaaacttagttttaccgggtacccgttaacggggaaaccgttaacccgtaacgttaaccgtaaaactttaaaaccggtaaaccgttacgggttacggttaccgtcggtaaccgtcctaaccgtaccgtacgttttacgtacccttacggttaccttacccccggttactacctttacttgtaaccc

SEQ ID NO: 143260 - DNA, 777 bp, Homo sapiens
  misc_feature: GYAE6OF02IY2DI.46.67.G01.1.454.CMB.1.raw
tcagactagcagtacacgaccggtgctcgatttagagtatacatattgggtttgtcctcctgctggtggcagctccagatgggtcctgtccctggtgcaactgcaggagtcgggcccagactggtgaggccttcgggagaccctgtccctcacctgcgctgtctcgtggtcgcctccatctagttacggttcggtttcttcgtggggctcggggtccgcacgcctacccggagggggacgggtctaggaactactagttgggaagttcgtctctactagttaggtgggtacggttacccttaattaccgacggttccgtctacctaacgaaggtacggtacgtacgtaccaacctacgttacttccgtacggtcggaacctaccggtacctaagaccttaaacgttccgttaaccggttttccccgaaggtaaacgtacgttacggtaccgttccggtaccggttaccccgccggtaccgtacggtaccggtaaccgggttacgttttacgttacgtacggtcgtaacggagtaacggtacgtagttacttagtgtttagtttggtacgttaggttacgttcgtaaccgtacgtacggtacggtaccgggtacggggtccgtaccggacccgggtacgggtaccggaacggttagtaccgttacggtccctaacggtccttaccgttaccgtcctaccgaaccgtaccggccgtaccgttccgttacccgtcccgtacgtcccgtaccctaccgtaccgaacgtcgtaccctaccgg

SEQ ID NO: 143261 - DNA, 734 bp, Homo sapiens
  misc_feature: GYAE6OF02HEOJW.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctcgacccagtctccatcctccctgtctgaccaaccgtgggagacagtcgtaccacatcacttcggccggacaagtacggaacattacgactacttaatttaaattgtatacaacataacgaccgacgggaccgaccctaagctacctaactctaatcgactcgacacgtcctagttagacgtaacggtcgggtaccagtacggtagttacgagtggacgtagtgtacgtacggtaggactaggtacttactactctaaccaacgtactacgtaacgttaacgtcgtacggtaacctaaacggtaacggttaaagttagtttttaacggaaccttaaaccgttttaagtttaaccgttacgtttaacctaaaaacgggtaaacttaaaaccgtttaaacgtaaacttttaccgggttttaaccggaaacccggaacggggtaaaccgtaaccggtaaaaccttaaaccgtaaaacgtttaaaaccgaacgttaacggtacggtacctaacggtaccgaacctagttacccgtacgttaccttaacgtccttacctacccgttactagttaccttaggtaac

SEQ ID NO: 143262 - DNA, 964 bp, Homo sapiens
  misc_feature: GYAE6OF02I266A.46.67.G01.1.454.CMB.1.raw
tcagactagcagtacacgaccggtgctcgatttagagtatacatattgggtttggggagtctcggtcaggacacagcatggacatgagggtccccgctcagctcctggggcctcctgctactctggctccgaggtgccagatgtgacatcgagctcgacccagtctccgatccctccgtgtctgcctaaccggtgggacgacgtcggtctaccgaacctacgttcctaccgttcggacccggggtagtaaacgggtaccggaaactacggtttaaccggaaccttaacccctttaaaagttttaaacgttgggttaacttaaccgtaaacgtaacgtaaccggtaacccgaccgggggtaacccggaacccccgttaaccgtaccttaacccgttaacgttacgttacgttacgcgtacgtccgtaccgttacccgttaaggtttccgtaacggttaacgggttaccggggtacccttaggttaccgggttacgttacggtaacggttccggggacgtaacggtggttaacggtccgggttaacgggaccgttaacggttaaccgtttacgtaacccgttacgtaacctaaccttacggttaaccttaaacgttaaccgtacgttacggtaaccgtaacgggttacgttaaacgttaacgttttaccggtaactttaaccgttagtttaaccgttaaccgtaacttaaccgttaaacggttaaaccctttaaacggttaacttttccggggtttaaacccgtaaccgggtaaacccggtaaggttaaaccccggtaaaatttaaacgttaaaaaaccgggttaaacccgtttaagttacggggtttacgtaccgttaaaccgacggttaaccccgttaacgtttccttaaccggtttacctaaccgtttaacccggtttcccctttacccggaacctttcccgttaacggtaccgtttaacccg

SEQ ID NO: 143263 - DNA, 624 bp, Homo sapiens
  misc_feature: GYAE6OF02F7MVQ.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgganacagtgtccaccatcacttcggccgggacaagtcgaacattcgacacctaatttaaatgtatcaacatacgacgaggaccgccctaagctactaatctatgctgcatcctagtttgactaaacgtgggtacccagtcgtaggttcagtggctaggtgatcgaggactagtattcactctacaaccgtatacaagtaactcgtacgtactaacggtagtaagttatttacgacttaaacttacttacttagtaacaaacgtaagttaaacttacttaaacgttcggttttacggaaccggtaaacggtaacctaacgtaacttaaacgtaaaacgttaaacgtaaacgttaggtacgtacgtacgtactaacctaacttacgtacgttaccttcgttaaccttccgttaccctactacgttactacgtaacc

SEQ ID NO: 143264 - DNA, 957 bp, Homo sapiens
  misc_feature: GYAE6OF02JD88F.46.67.G01.1.454.CMB.1.raw
  modified_base (911)..(911): a, c, t, g, unknown or other
  misc_feature (911)..(911): n is a, c, g, or t
tcagactagcagtacacgaccggtgctcgatttagagtatacatattgggtttggggagtcctcggtcaggacacagcagtggacatggacgggtccccgctcgaagtcctccggtggggcctccctgtcttaccttcgtcggtcctaccggtaagggttcgacccgaagtagttggtacgtactacgtaccggagtccgttaccggaacccccgtagttccctacccgtacttcccccgttacccgttgttccgtcggacccgtaaccggggtaggggaaccgacgtaggttacctaccaaccacttaccgtaccgtttccggggccggggaaccgtaaacgggttaccggaaaccttagtttacccggaacccttaaaccgttttaaagtttttaaaccggttaggttaactaaccgtaaaactaagtaaaccgggaacccggtaaccgggggtaaccccggtaacccccgttaaacggtaccctttaaaccccgttaaattacctttaaggttccgtaaccgttcggacccttaaccgtttcccggtttaaagttttcggaaaccgggttaaacggggttccccggggttacctaacggttacgggttaacgggttccgtaagggttccggacggtaacggggtacggtttaaaccgttccggggtaaagggggtaccctaaacgttttaccgtttaaccggacccttttaacccgtaacctaaacccggttacctaaggtttaaccgtaaccgtttcggaccgttaacggtaacgtacggttattttaacgttacgtaactttacgtttaattccgtataaccgtactaagttaaccttagtcgtttacgtacgaccgtagactaacgaacctaataaagtaactgtggacctcacgtgaacctgtnttaccggtcttaccgtactttcccaccgagtttctaccgtgtaacc

SEQ ID NO: 143265 - DNA, 753 bp, Homo sapiens
  misc_feature: GYAE6OF02GIGEB.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcgggacaccctgtcccctcacctgcgctgtcctctggtcncctcgatcagttagtcgtttctcgtgggtctgggtccgcagcctccggagggagggctggaactacgtagttacggaagtcgtaccttcgtactaataggttagggtacggtttcctaactttacgacggttccgttccttcgtaccgaaggtcgtcgtaacgtccaacctatactcttcgtacggaactccgtaccgaagtactacgtcttacgttttcccaggtaaacgtctaggtagtttcgtcggtactcccggaccgtctaggaccgtacgggttactttagttacgtggttacgcggtaaggacggtaacgtactttagttaacggttgttttaagggtttttacgggtaagttttcgggtttacctttacggtaacccttaccgttaacggtacggtaccggggtaccgggtacccgttaccccgggtaccccggggttacgggtaacccggtaagggtaaccgttaccggtacgggttacccgttaccgggtttaccctacccggtttacccgccccgttaaccccggg

SEQ ID NO: 143266 - DNA, 615 bp, Homo sapiens
  misc_feature: GYAE6OF02HUX8R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgcaccatcacttgccggcaagtcgaacattgactacctaattaaattgatacaacatacgaccagggaccgcccctaagcctacctaatctatgactgcagtcctagtttgacgaaagtcgggtccagtcgaggttcgagtgcagttggatcggtggacagtacttacactctacacctagtacaattaactcgtagacgtaaacgtagaacgttaagttttacgactaactttaattacttagtaacaacgtaataagttaactaattcggtttaccgacgtaacggaaccgaacgaacctaaacgtaaaacttaaacgaacgttaggtacgtaccgttagtacccgaactaacgttcgttacgttaccgtttactaacgttcccgttaccccgtacctaacgttcctaagtaaccg

SEQ ID NO: 143267 - DNA, 813 bp, Homo sapiens
  misc_feature: GYAE6OF02F0C1E.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttgtcctcctgctggtggacagctcccagaactgggtcctcgtccctggtcgcaactgcaggagtcggcccacgactggtgacggcccttcggagacccctgtccccgtcaaccgttgccgcgttgtacttcgtggtcgtccctacctatcaagttacggttcggtttcttacggtcggggtaccttcggggtcccggacncgtctacccggaaggggtaacgggcctaggaactacgtagttggaagtgtccgtccagtataggtggtacgttaccctagttacgacgttccgtctcgtactagtacgtcgtacgtaccaactattacgtcctacggtcggaaccaccgttaccaacggtacctaaagttccgtttaccgttttaccccgaagttaaacgtcgttacggttacgttaccgttcggtaacccgtacccgggtaccgtaccggtacggtaaaccggttacccgggtttacgttttactttacggtacgtcggaacggtaacggaccggtacggttacgtttaagtttaagttacgtttggtttaagggtcgtttacgtttacgttaccgtaaccgtaccgttagacggtacgggtaccggtccctacccggtcccggtagggaccgtacgggtaacttcgggtcctacccgtccgttcgtaccttaccggccctaccgaaccggttcggcccgtcgttacccgttaccccgttcccgacgttccccaccgttacccgcgtaccgtctacccgg

SEQ ID NO: 143268 - DNA, 919 bp, Homo sapiens
  misc_feature: GYAE6OF02H25MC.46.67.G01.1.454.CMB.1.raw
tcagactagcagtacacgaccggtgctcgatttagagtatacatattgggtttgggggacctcctgtgcaaagaacatgaagcacctgttggtttcgtcctctgcgtggtggcagcctccgagtagtcgggtcctgtcccgtggtgaccaacgtggcgaagggtacggtccgggccccaagtacgtgggtacggacggtcccgtttcgggaaccgtacccttcgtacccctacaaccgttcggccgtccgttaggttccttcggttcgggtccgttaaccctccgtaattccgtaaagggtttacggttttcggtttttcgtcggggtaacgggggttccgttcgggggtcccgacgtcggttaacccgaccggggaaagggggaaaccggggtcgttaaagggtaaactacgtaaggttaacggtaaagttcggtacctaccgtagtaaggttaggtaccggttaaccgtttcctaacgttaccggtacggtttccctacgtaccggtaaacgtacggaaggtaccgtaacgttaccaacgtaattcctaccgttcgtacgggaaaccttccggactaacggtactaaacgttccgtttaaccgttacgaaaggtaagtacgttacggttcgttaacgttcggacggtcccgtacgaccgtacggtaacggtaccgtttacgtttaacgtacggtaggttcggaacggtacggaaccgttacgggtaactttagttaacgttagtttacggtttaaggttacgtttagttaacctttccgaaccttacgtaacggttacgaccggggttaccgggtccgttacccggtaaccgggtacggggaaccggtaacggggtactttaaccgggacgtttaccctaaccggttcccttacggttccccgtaaccgtaacccgg

SEQ ID NO: 143269 - DNA, 889 bp, Homo sapiens
  misc_feature: GYAE6OF02IPOBP.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggtccttcgggagacccctgtccctcacctgcgctcgtcttctggtgcctccagtcagttagttggtttcttcggtgggtcttggggtccggcacgtcctcccgaggggacgggtctaggaactactagttacggaagttcgtacctctcagttacggtaggtacgttaccttattacgacggttccgtctccgtacgaagtacgtacgacgtaccaacctacttaactcgttaccgtacggtaaccgtaacccggtcccgtaagacctaaactttcccgtttaacgtttttccccgtaaggtaaccgtagtttacggtacgtttacgttacggtaccggtaccgtcccgtacgtaaccgggtaccgttaaccgggggtttcctttttaacgttacggtttcgggtccggacggtaacggacggtaaccggtttcttttaaagtttacggttagtttttacgggtttttggttaagggttttaccgggtttttaacgtttcccggtaaacccgtttaaccggtttagggtaaccccgtacgggggggttaaccccggggtccttaccccgggtacccgggtaccggggtaccgggtaaaccgggttaacgttacggttccgttaacccctccggttccctaccggttttaccaccccgttacccgaacccggtaacccgggtccccgttaccggtttcccgtacccccgttcccgttccggaccccttacccggtaccctaccgtacggtccgacccgg

SEQ ID NO: 143270 - DNA, 777 bp, Homo sapiens
  misc_feature: GYAE6OF02GMJYL.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgagggcccttcgggacgacccctgtcccctcacctgccgctgtcctcgtggtcgccctccatccagtagtcgtttctcgtggggtctagggtccgcagccctaccggagggggaagggctaacggaatacgtagttaggtaaggtctctacctagagttaggtcggtacggtttacctaacttaccgacggtcccgttactcctaacgaacggtagtaccgaacgtaccgaactaattcgtcctacgtacgggaaccaacgtccaagtacctaattccgttaccgttttccaagtaagatcggtagttacctggaccgccgtacgacgtaggaaccgtccgggtttatttaaacgttcgtggtacccgaggtaacgacgggtaacgtacttagtttagttaggtttacgtttagggttacgtttaggtttaccgttacggtaacgtaaccgttacgtaccgtaccgggtacgggtaccgtcccggtacccgggtcggacggtaacgggtactaccggttacgtaccgtaccgtccgttaccgtaccgtacccgaacccggtaaccgtaaccggcccttaacgtccccgttacccgttccccgtacggtacccctaccccgttacccgtaaccctacggtaacctaccccgg

SEQ ID NO: 143271 - DNA, 751 bp, Homo sapiens
  misc_feature: GYAE6OF02G7A6D.46.67.G01.1.454.CMB.1.raw
  modified_base (269)..(269): a, c, t, g, unknown or other
  misc_feature (269)..(269): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccgtgtctgcctaaccggtgggagactagtgtcacatcacttcggcggcaagtccggaactattacgacctaccttaatttaaagtgtaatcaanagtaacgaccgagggaccggaccctaagtcctacctaatctatcgctcgactctacgtagttacgacgtaagggtcgggtaccctacgtcgtacggttcgaggtacggtacgtaggtacggtacggttcgtacggggaactaggttaccttactacctaccgtacaaccgtaactttacgaacgtttactccgttacggtaacgtaaacgttaggttaaactttacgtttaacaccgtttaaagtttactttaaccgttacggtaaaccttaaacgtaattaaacgttaaacttaccgggttttagtttaacccggggaaacgttaacggggtaacccgaaacgttaaacgtaaaacgggtttaaaaccttaaaggtaaacggttacgttaacgtacccgtacgtaccgtaaccgtacgttaccgtttacctacgtttaccgtaccttacccggtacccgtactcggttacctacgtaaccg

SEQ ID NO: 143272 - DNA, 745 bp, Homo sapiens
  misc_feature: GYAE6OF02F2N6E.46.67.G01.1.454.CMB.1.raw
  modified_base (213)..(213): a, c, t, g, unknown or other
  misc_feature (213)..(213): n is a, c, g, or t
  modified_base (740)..(740): a, c, t, g, unknown or other
  misc_feature (740)..(740): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtgcctcatcagtagttggtttcttcgtggggctgggtccggcngtcctcccgaaggggaaggggctagggtaactactagtggaagtgtcctactcagttagtcggagttccttattacgacgttaccgtcttctacgagaggtacaacgtcaacctatattcgtctacgacaccgtacacgactaattctacgttttcccagaagctagtacttcgtcggtacgaccggtcgaccgtgaacgtcgggttattttaacgttacgttggtcgtacgggtaagacgggtacgtacgtaagtttagttaagtttggttttacggaaggtttcgtttaaccgttccgtaacctaacccgttaggaaccgttccggggacgggttccgtaccccggtacccggtagggggacccgttaaacgggtaggttaccgtacggttaacccgccgtttccgtttaacccgtccgaccccgtacccggtaaccgtacccgggtaccgtaacggtttccccggtaacccctttcccggttaccggccccttaaccccgtaccctacccggacgttaaccccncccgg

SEQ ID NO: 143273 - DNA, 801 bp, Homo sapiens
  misc_feature: GYAE6OF02F72S2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctcccgtgtctgaccgaaccggtgggagacagttgtccaccgatcacgttcggccgggacaaggtccggaatattacgacctaaccttaatttaaagttggtactacaacagtacgaccgacgggaccgacccctaagcctactaatctatgctcgactacgtctaggttgaacgtaagggtcgggtaacccagtaccggtaggttacgacgggtggacctagggttaggtaactcgggtaacgggtaactaaggtttactttaccgtacctacccttacctaaaccgtacgttaacgtaacgttaacttacggtacggtaaaccgttaaaccggtaaggttaaacgtttaagttttaccggaaaccttttaaacgtttaacgtttaaccgtttaacgaaacgttaaccgtaaagggtttaaacctttaaaccggttaacggttttaacccggtttaacgggaacccgttaaacgggtaaaccctacggtaaaacgttaaaaccgtaaaaacgtttaaaccggttaagtagttaacgaccgttacgtaccctaaacggttacttacggttaaccttacctttaacgttaccttcccggtttaaccgcctttaacgtacgtaccgtttaac

SEQ ID NO: 143274 - DNA, 995 bp, Homo sapiens
  misc_feature: GYAE6OF02H9UAO.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcccgtttcggacgaccctcgtcccctcaccgtgccgctgtctcgtggtcgtccctccatctagttaggttggtttcctcggtcgggggtcgttcggggtcccggcacgtccgtccccggaagggggaacggggcttaacgggtaactacgtaagtttagggtaacggttcgttccttactaccgtagttacgggttcgggtacggtttaccttaacgtttaaccgacggtttcccgtccttccgtacgaaggtacgtacggtacgtacctaaccgtaattacgtaccgtcgtaacggtacccgttaaccgtaccccgaacgtacgttaacgtacgtttaaccggttttaccgaaggtaaagtggttacgttacggttcgtttacgggccggtaacccggtcgtaccggtacgtaccgggttaccgggttacgttttacgttacggtgggtaccggtacggtaacggtacgggtacgttaccgtttaaggtttacgtttaggttttaggtttagggttaacggtttacggtttttaacgttaccccgggtaaccctttaaccgttaaccgggtacgggttaccgggggtaccccggggttacccggttaccccgggttaacccccgggggtaacggggtacccgtaaacgggggtaaccgtttacccgggttaaccgtccccggttaccgttaacccgtttaccccggttaaccggtacccccgtaacccgtaacccgggtaaccccgggttacccggttacccgggttaacccccggttcccccgttaccccccggtccggttaacccccggttacccccccttacccggtaacccggtaaccccggtccggttaaccccccgg

SEQ ID NO: 143275 - DNA, 1146 bp, Homo sapiens
  misc_feature: GYAE6OF02IOA6B.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggccacgactggtgaggccttcggacgaccctcgtaccctcgaccgtgccgtctgtcgtcgtggtcgccctcctatccgtagttagttcggtttcttcgggtgggtcggttcggggtcccgcgtacggtccgtacccggaagggggtacgggtcgtaaggtaacttaaccgtaagggttaggtaagttcgtccttcgtacgtacgtaggttacgggtacgtttacctaacgttacggtacggttcccttacgttacgaacgtaggtacggtcgtaacgtacccgtaaccttaagttaaccgttccgtaacgtacggtaaccctacgtaccgtaacccgaaacgttactttacccggttttaaccggttttaacccggtaaggtaaaaccgtttacgttacgggtttaacgttttaccggtaccgggttacccggtaccccggtccgttaccggtaacggttaacccggggttaaccgggtttttacgtttttaaacgtttaaccggtcggggttaccggttaacggggaaggttacccggggtaaacggtttttaaccgtttaaacggttttaacgggtttaccggtttttttaaaggggttttacgggtttaaccgggtttttaggggtttttaaacccgtttaacccgggtttaaaaccccgtttaacccgggttttaaaggaacccggggggttttacccggggggtaacccggggtttaccccggttaccccggggtaacccccgggggttaaccggggtttaaacccggggtaaccggtttaaaccggttcgggttaaaccccggtttcccccggttaacggttttaaccccccggtttaccggggttacccccttaccccggttaaaccccgtaaccccggggggtaacccccgggttaacccggtttccccggttaccccggggtttttaaccccccgttttccccccgggtaaccccggttccccccgttaaccccccggtttaccccgaaccccgggtaacccgggttccccggttaacccccgg

SEQ ID NO: 143276 - DNA, 697 bp, Homo sapiens
  misc_feature: GYAE6OF02GKVMO.46.67.G01.1.454.CMB.1.raw
  modified_base (202)..(202): a, c, t, g, unknown or other
  misc_feature (202)..(202): n is a, c, g, or t
  modified_base (340)..(340): a, c, t, g, unknown or other
  misc_feature (340)..(340): n is a, c, g, or t
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgaggtccccgctcagctcctggggctcctgctactctggctccgaggtgccagtatgtgacatcgagctcgacccagtcctccatccctcctcgtctcgcctaaccggtggacgacngtcgtcaccatctacgttcggccgggacaagtccggaactagttcgacctaaccttaaatttaagtggttactacaaactaagtacgaacgtacgggaacccggtacccctaaggccttaaccgtaactacgttaacncggttcctagacctacgttacccgtagtttacggaacgtaaacgggttcccgggtacctaacggtccgggtacgtttacgaggttccggagtaggtcgagtcggtaggactaaggtacttcgaactctaccacgtactacgtatacgtactcgtacaaggtanaagttagtttactactaacgttattacgttacgtacaaacgtaagtaattaaacctagtttaccggttaacgtaccgaaggtaaccctaacgaaacttaacgtaaaacgttaaacgtaacgtagtcgtacgtacgactaaaccctgtaaccgtacttccgttacctactccgttcccatacctagtccgttaac

SEQ ID NO: 143277 - DNA, 651 bp, Homo sapiens
  misc_feature: GYAE6OF02G2VF0.46.67.G01.1.454.CMB.1.raw
  modified_base (121)..(121): a, c, t, g, unknown or other
  misc_feature (121)..(121): n is a, c, g, or t
  modified_base (141)..(141): a, c, t, g, unknown or other
  misc_feature (141)..(141): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
  modified_base (352)..(352): a, c, t, g, unknown or other
  misc_feature (352)..(352): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (472)..(472): a, c, t, g, unknown or other
  misc_feature (472)..(472): n is a, c, g, or t
tcagactagcagtacacgaccggtgctcgatttagagtatacatattgggtttggggagtctcggtcaggacacagcatggacatgaggtccccgctcagctccgtggggctcctgctacnctgctccgagtgccagatgngacatcgacgctcgacccatcctccatccctccgtctctcgaccaacggtggagtacagttcgactccgaatcactggccggnaagcgaactntcgactaccttagttaatcgaatccaatgacgacagggaccgcctaagactcctaanctactagccagactactcctagttacaagtaagtcggaaccgactccgtaaggtcaaggtnaccgtagtagggtatacggtcggaagtggtactttacgacctttacnccagntacagtaactcgtacgctaaaccggtaggatagttacgtacctaaggtactttacgaaactctaaacngttaaacctaaagtagttacgtttaaccggaccggaaacgtaccgaaacgttaaacctaaagtaaaccttaaaacgggtacttacgggtaacggtcaactacgtaacgtaaccttcttaaggtccctttaaggaacctttccccgtaaacggtttccccaagttaccgtattaaaccgg

SEQ ID NO: 143278 - DNA, 763 bp, Homo sapiens
  misc_feature: GYAE6OF02JZJF6.46.67.G01.1.454.CMB.1.raw
  modified_base (228)..(228): a, c, t, g, unknown or other
  misc_feature (228)..(228): n is a, c, g, or t
  modified_base (527)..(527): a, c, t, g, unknown or other
  misc_feature (527)..(527): n is a, c, g, or t
  modified_base (724)..(724): a, c, t, g, unknown or other
  misc_feature (724)..(724): n is a, c, g, or t
tcagactagcagtacacgaccggtgctcgatttagagtatacatattgggtttggggacctcctgtgcaagaacatgaagccacctgtggtttcgtcctcctgctggtggcagctcccagatgggtcctgtccctggtgcaacgtgcgaggagtccgggcccacgacgtggtgaggtccttccgggacgaccctggtcccctcacctggcgtctcgtcctctgggtcncccttaccatcgaagttgttcggtttctacggtggggacttcggggtccgacaggtcctacccggagggtaacggggtctacggggaattaccgagtttacggaacgtgtctctcaagtagtagggacggttacctagttacgaacgtccgtctcgtacgtaagtcgtacgacgtcgacctatactcgcgttacgacgtacctacgacgtcaaacgttctaccgttttacccgagtagtactgtaacttcgtgtacgaccaccggtctacgtaccgtacgggttacttacgttttacgnggttacggtacggacgtacggtaccggtcgtttactttaacggtgtttaacgttttaccgggtagggtttacggtttaacttttaccgaaaccgttaccttaaccgggtaccgggtaaccgggtccgggttacgtaaccccgggtccccgggtttaacgggacgttaaaccgggtacttaacccggtcggtttaccncccgggttaccttaccggtacgtaccccttaaccccggg

SEQ ID NO: 143279 - DNA, 854 bp, Homo sapiens
  misc_feature: GYAE6OF02H2M8V.46.67.G01.1.454.CMB.1.raw
  modified_base (138)..(138): a, c, t, g, unknown or other
  misc_feature (138)..(138): n is a, c, g, or t
  modified_base (328)..(328): a, c, t, g, unknown or other
  misc_feature (328)..(328): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtncaactgcaggagtcgggcccacgactggtgaggtccttcggacgaccctgtcccctcacctgccgtctgtctcgtgggtcgccctccgatcaaggttgttcggttttcttccggtggggtcgttggggtcccggcacgtcctacccgagggggaacgggtctaggaactacgtagttggaagttgtcctntcgtagttaggtcgggtacgttcctagttacgacggttcccgttctccgtacgaaaggtcgttccgtaacggtccaaccctattaactccgtacgtacgggtaacctaccgtccaacggtacctaacgttcctttacggttttacccaagggtaaagtacgttaggttacgtttcgtacggtaccggacccccgtaccgtcgtaacgggtaccgtaccggggtttacttttaacttacggtgttaccgggacggtaacggtaacggtccggttacttaaggttttacgtagtttttaacggttttacgggtaacggttttaccggtttttaacgttaacccggtaacccgttaaaccggtttaaacggtcgggttaccccggggtcccggggttaacccttacccccggggtaaccccggggttacggggtaacccggtaaacgggttaaccgtacccggttttaccgggtaccccgttacccggtttacccgtttaccgttacccggtcccccttaaaccccggg

SEQ ID NO: 143280 - DNA, 736 bp, Homo sapiens
  misc_feature: GYAE6OF02HSBG9.46.67.G01.1.454.CMB.1.raw
  modified_base (394)..(394): a, c, t, g, unknown or other
  misc_feature (394)..(394): n is a, c, g, or t
tcagactagcagtacacgaccggtgctcgatttagagtatacatattgggtttgtccgtcctgctggtggcagctcccagatgggtcctgtccctggtgcaactgcaggagtccggcccacgactggtgagcttcggagaccctgtccctcacctgcgctgtctcgtggtcgtcctccatccgagttacggttcggttttctcgtcggggcttcggggtccggcaggccctacccgaaggggacgggtctaggaactacagtttcggaagttcgttctcgtcaacgtaaggtcggtacgtttcctaattaccgagttcccgtctcgtaacgtaaggcgttaccggagtacccgaactattaacttccgtcgttacggaccgttaccgtccgaanacctaacgttcttacggtttccccaggtaaacgtcgttacgtagttacgtcggtagcccgtacgcgttacgaacggttcggtttacgtttacgtacgttggcgaccgtagacggtacgtaacgtattagttgttagtttaggtacgtttcggttattaccgtaacgtacgtaagtacgtaccgggaccggggtcctacccggttaccggtaccgggtacgaacgggtagtaaccgtcggttaccgtaccgttctaccgtccgttaccgacccaacggtacccgtaccgtcgttaccgtcccttcccggacgtccctacccgtaccgtacgacgtccgtaccg

SEQ ID NO: 143281 - DNA, 757 bp, Homo sapiens
  misc_feature: GYAE6OF02G9KOP.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagcctccgagggagggctaggaatacagttggaagtgttctctcagtagtggtaggttcctattacacgttccgtctctcaagagtcgagtcacatatctctggactacgtccagacaatcgtacgttttcccaggtaagattaggtacgttcgtggtcgtacccggtccgtcgttacggacgtacgggttcgttttaacgttacgtggttacgacggaacggtacgtaccggtacttaatttaagttagtttagttttagggtagtttaggtttaacgtttaccgtaaccgttaacccgttaggtacggtaccgggtaccggggttcccgttacccggtaccccgggttacgggggacccgggtaagggttaaaccttaccgggttacgggttacccgtacccggttacccgttcccgtttacggtacccccgtaacccgtaaccccggtaacgggtacccctaacggttccccggtttaccccgtttcccccggtacggtacccctacccccgttaccccggtaaccgtaccgaccggtaccccg

SEQ ID NO: 143282 - DNA, 714 bp, Homo sapiens
  misc_feature: GYAE6OF02I480I.46.67.G01.1.454.CMB.1.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
tcagactagcagtacacgaccggtgctcgatttagagtatacatattgggtttggggagtctcggtcaggacacagcatggacatgagggtccccgctcagctcctggggctcctgctactctggactccgaggtgccagatcgtgacatcgagctgacccagtctccatcctccctgtctgcaaccgtggganacagtgtacaccatcacttagccgggacaagtacggaacattcgacaacctattaaattggaattcaactatagaccagggaccgaccctaanctacctatctatgctgcatccagttcgactaaggtcggtaccacgtgtaacggtcgagtaggcgtacgtagactcggtaggactacgtacttcgtaactcgtaccacgaacttcgaagtaactcgtactacgtaacggtataaagttatttacggtacttaaactttacgttaaccgttcgtaactaaacgtaacttaaacttaacgtaagtttaaccggtttttaccgggaaccgttaaacgggtaaacccgaaccgtaacgttaaaacccgttaaaaagttaaaaccggtaaacgttacggttaacggacgtttacggaaacccgttaacccggtaaactaacgttttacggttaacccgttttattaaccctttacccggttaccccgttaacccggttaacttaaccggtttacttaaaccgg

SEQ ID NO: 143283 - DNA, 873 bp, Homo sapiens
  misc_feature: GYAE6OF02F5KTA.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtcgcaactgacaggagtccgggcccacgactggtgaggtccttaggacgaccctgtccctcacctgcgctgtctctggtcgtccctcatcgagttagttcggttttctcggtacggggtccttcggggtcccgacgtacgcccgttacccggaagggggtaacggggtcgtacgggtaaacgttaccgtaagtttaacggggaagttcggtttaccttcgtactaacgttagggtacgggtacggttttaccgtacttacgtacggttcccggtcttaccgtacgaacgtagttccgtacgtcccaacgtatctaccgtacgttcggaacctaccggtacacgtacgtaacttcgtttaacgttttcccgaagtacgtaagtttacgtacgtttcgttacggtaccggtacccgtaccggtaccgttacggtaaacccggttacggggtttaccgttttaacggttacttcgggttacggacgggtaacggttaccgggacgggttaccttttaacggttacgtttacggttttaaggtttttcgggtaacggtttttacggtttacgttttaccggaacccgttaccgttaacgggtccgttaacccgggggtcgggttacccgtaccccgggttcccgggtaccggggaccgttaagggtaaccgtttaccgggttaccgggttaccccgtaccggtttaaccgtttccccggttaccgtccccgtaaccccggg

SEQ ID NO: 143284 - DNA, 818 bp, Homo sapiens
  misc_feature: GYAE6OF02ION4P.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactcctggctccgaggtgccagatgtgacatcgagctcgaccctagtcctccacgtcccctcccgtgtctcgaccgaaccggtgggaacgacgagtcgtacaccgtactactacgttcggccggacaagtacggaactagtacgacgtaacttaagtttaaacgtggtaactactaaacgtagtaaccggaaccggacggacccgtaacccctaaggtccctaacccgtaagtacgttacgtacgtactcgacctacgtaccgttagtttacggaacggttaacgggtccgggtacctaggttcggtaacggttacaggtcggattacgggagtactacggtacgggaactagttacttaccgactacgtaacctacgaagtactaagtaactcgtaacgacgtaacgtagtaagtttacgtacgtaaccttaagtttaaccgttacgtaacgtaccgaaacgttaacgttaacgtttaaccttaaggtttccgggtttaaccggaaccgtaaacggtaccgttaaaccgaacgtttaaaacccgttaaaacggttaaacctaacgtacgggtttacgtaccgtaccgtaacccggttaacttaacccggtttacgttaacccggtttacccttaacccggtttacccgtaccccgtttacccgtaaccccgttagttacccgttttaagtaaccccgg

SEQ ID NO: 143285 - DNA, 731 bp, Homo sapiens
  misc_feature: GYAE6OF02HZ1CH.46.67.G01.1.454.CMB.1.raw
  modified_base (260)..(260): a, c, t, g, unknown or other
  misc_feature (260)..(260): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggccacgactggtgaggccttcggagaccctgtcccctcacctgcgtctgtctctggtcgccctccatcgaggttgttggtttcttcgtggggtcttgggtcccggnacggcctaccggaggggaacggggctaggaactacgagttcggaagttcgtacctcgtcgtaattaggtacggtacggtttaccttaagttaccgacggtttcccggtcttacgttacgaaggtacgtcgtacgtaccaccgtatacgttctacgtgacctacgtcagtacaacgtctacgttttcccgagtaagtacttgtacgttctacggtcgacccggtcgtacgtacgaccggtaccggttctttacgttacgtcgtacggtcgaacggaggtacggtctaagttagttacggttagttttacgggtaggtttacggtttaaccgttaccgtaaccggtaacccgtaaggttacccgtaccggggtaacccgggtccttaccccgggaccgggttccggggacgtaacgggtaacttccggttacgtcccgacccgttaccgttacccgtacgtcccctaacccgg

SEQ ID NO: 143286 - DNA, 777 bp, Homo sapiens
  misc_feature: GYAE6OF02GOPFU.46.67.G01.1.454.CMB.1.raw
  modified_base (101)..(101): a, c, t, g, unknown or other
  misc_feature (101)..(101): n is a, c, g, or t
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
tcagactagcagtacacgaccggtgctcgatttagagtatacatattggggtttgggggagtctcggtcaggacacagcactggacatgagggtaccccgntcagctcctggggctcctgctactctggctcgaggtgccagactgtacgacagtcgagctggaccctagtcctccacttcctcccttggtctcgacgtaaccggtgggacacagtcgtcacatcacgttggaccggacaaggtccggaactnttacggacctaccttaagtttaaagttcggtatacgtaaanacgttaacggacccgaacggggacccgtaccccgtaaaggcccttaaccgtaaacttcgttaacgttcggtcctacggtcctaacttacccgttacggttttacgaccggtaaacgggttccgggtaccctagttaccggtaggttaccgtagggtcggtacgaggtcgggtattaccggtaggggactacgttacgttccaaccttcctaccgaaccttacgtactaaggttaactccggtagtaccgtaaacggttacgggtaactttagtttacggtaactttaacgtttacgttaacgttacgtaacctaacgtttaacttaaacgtaacgtttacggtttacgggtttccggaaccgttaacggacctaaagtaccttaaacgttaaacgtaacgttacgtagtacgcgtactacctaacggtaacttcgtaccgttacgtacttccttacggtaccctacgtcttacgctttaaccg

SEQ ID NO: 143287 - DNA, 673 bp, Homo sapiens
  misc_feature: GYAE6OF02GNG7G.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctcgacccagtctccatccctcctgtctgcaaccgtggganacagtgtccaccatcacgttggccgggataagtcggaactagttcgaacctaaccttaattttaaagtggtatacaactaatacgaccgacggggaccgtacccctaagcctactaatctatgactgacacgttacctagtttacgacgtaagggtcggtacccctaggtaccgtaggttcacggtgacgtaggtgtacgtcggtacggaactagttacttcgtaactcctacctaccgatactacgtactacgtacgaacgtaacggtaggtaattagtttacgaccttaaactttacttaccgttaacgtaacctaaacgtaacgttaaactttacgtaagtttacgtttaccggaaccgtaacgggaacctaaccgtaactaaacgtaaacgttaaacgtacgtaggtctacgtcgacctaacgtcttccgtacttaccttctaccttcccgtaccctactaccgttcttagtacg

SEQ ID NO: 143288 - DNA, 697 bp, Homo sapiens
  misc_feature: GYAE6OF02H8AMB.46.67.G01.1.454.CMB.1.raw
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
  modified_base (367)..(367): a, c, t, g, unknown or other
  misc_feature (367)..(367): n is a, c, g, or t
  modified_base (423)..(423): a, c, t, g, unknown or other
  misc_feature (423)..(423): n is a, c, g, or t
tcagactagcagtacacgaccggtgctcgatttagagtatacatattgggtttgggggacctcctgtgcaagaacatgaagcacctgtggtttgtcctcctgctggtggcagctcccagagtgggtcctgtcctggtgcaactgcaggagtcgggcccacgactggtgaggcttcggagacctgtccctcactgcgcttgtctcgtggtcgcctcatcgagttagttgtttctgtggggctgggtccgnagcctccggagggaggcgtaggatacgataggaagtcgtctntacatagtggtcgttacctattacacgttccgtctctacgaagtaggtcgtagccactatcttacctcgtacgacnccgtccgacactaacgtactacgtttcccgtaagagtatcgtacgttctcggtacnccgtcgactacggtaccgtcggttacgtttacttacgtcggtcggtaggtaacggtacgggtacgtctttaagtttacgttacggtttaggttttacggtagggttttaacgttttcgtaacccgttaaccgttacccggtaagttacgggccgggttaccggggtccgttaccccggggtaacccgggttcggggtaacccggtagggtaacttcccggttaggtaaccccggttacgttccccgtttacggtacccgttcccgtaaccccgg

SEQ ID NO: 143289 - DNA, 636 bp, Homo sapiens
  misc_feature: GYAE6OF02GLWHP.46.67.G01.1.454.CMB.1.raw
  modified_base (209)..(209): a, c, t, g, unknown or other
  misc_feature (209)..(209): n is a, c, g, or t
  modified_base (416)..(416): a, c, t, g, unknown or other
  misc_feature (416)..(416): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagtggtttcttcgtgggctgggtccgnagcctccgaggggaacgggctaggaatacagttggaagttgtctctacagtaggtggtacggttcctattacgagtccgtctctacagagtcgagtcactatactctcgtggacacgtcagctaatctacgtttccagtaatagtgtagttcgtgtcgaccgccgtctagacgtacggttgtttacttcgtgtagcgagacgacgtntagttgtgttagtttggagttgttacttcgactaccgtagtacgtacgggtccgggtcgtacccgtccggtacgggacgtaacgggtacgtacgtcgtaccgtaccgtaccttaccgtaccgtaccctaccgtacccggaaccggtcccgtaccgtcccggttccccgttaccccgttccgtacccgtaccccttaccgtaccgtaccgaccgtacccgg

SEQ ID NO: 143290 - DNA, 815 bp, Homo sapiens
  misc_feature: GYAE6OF02GJ0AU.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattggggtttggggagtctcggtcaggacacagcatggacatggagggtccccgctcagctccgtggggctcctgctactctggctcggaggtgaccagatgtgacatcgagctcgaccctagtccnccactcctccttgtctcggaccgtaaccgggtgggaacgactagtacgaccacctatccgtacgttcgggaccgggtaactaaggtaccggaaactagttaccggaaccttaacctttaaagtttaaagttcggtaactaacgaaacgtaataccggaacgtacggggaccccgtaccgtaagtcccgttaacttactacgttacgtcgtcgttacgactacgttacgtagttacggaacggtaacgggttccggtacctaggtacgttacggttcaacggttcgacgacggttagacgtacggtacgataacgttactactcgtacctacacgttacacgttaagtactaccgtcgtaacgttaacgtacgttaacgtttacgtacgttaaccgtttaacttacggttaactacgtaaacgtaaacggttaaagtttacgttaacgttaggttttaacccgggtcgggtaaaacccggtacggttaaaccgtaaacccgttaacttaaaaacccgttaaacggtttaaaacccggtgttaccggttaccggttaccgtacgtaacccgtcgtttacggtacccggttcttacccgtacttcccgttaccgtacccgtcgttaaccgttacgtaactaacccgg

SEQ ID NO: 143291 - DNA, 675 bp, Homo sapiens
  misc_feature: GYAE6OF02JXJZR.46.67.G01.1.454.CMB.1.raw
  modified_base (145)..(145): a, c, t, g, unknown or other
  misc_feature (145)..(145): n is a, c, g, or t
  modified_base (219)..(219): a, c, t, g, unknown or other
  misc_feature (219)..(219): n is a, c, g, or t
  modified_base (366)..(366): a, c, t, g, unknown or other
  misc_feature (366)..(366): n is a, c, g, or t
  modified_base (407)..(407): a, c, t, g, unknown or other
  misc_feature (407)..(407): n is a, c, g, or t
  modified_base (543)..(543): a, c, t, g, unknown or other
  misc_feature (543)..(543): n is a, c, g, or t
  modified_base (622)..(622): a, c, t, g, unknown or other
  misc_feature (622)..(622): n is a, c, g, or t
tcagactagcagtacacgaccggtgctcgatttagagtatacatattgggtttggggagtctcggtcaggacacagcatggacatgagggtccccgctcagctcctggggctcctgctactcgtgctccgaggtgccagatggtnactagtccgagccgtcgacctaggtctaccactccctcctgtctagacgtaccggtggacgacgtgtgtccacngtcctacgttcggaccggctaagggtaccgaaactgttcgaactacgttaagttttaattcggacttacaaatcgggtaaccaccgtacggggaccggtcccctaagtctcccgtaatcgttatcgcagtcaacgttcgtagtttanaccgtaagggtttccggacttacgtcgttacggtcctaggngcgttaggcgttagtcgaacgggtctaaacggttcttcctaaccgcttaacgaccttacgtactaagttgttactacgtacgttaacgtcgttaaacgtttcttagttaacctttaactagttctaacgtactaanaccgttaatctacggttttgtaccggtaagtcgaacgtactacgttaaacacgtacgtaacgttgacgtcgctacccgnttaacgttcgcctttaacttcgtccttaccggccttacgataccgttacgacg

SEQ ID NO: 143292 - DNA, 736 bp, Homo sapiens
  misc_feature: GYAE6OF02GNPVV.46.67.G01.1.454.CMB.1.raw
  modified_base (259)..(259): a, c, t, g, unknown or other
  misc_feature (259)..(259): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtcccctcacctgcgctgtctctggtcgcctccatcagtagttggtttcttcgtggggctgggtccggcagcctcccggaggggagggctaggaatacagttggagtgtctctnatagtggtagttcctattacgcgtcctctctacgagagtcgagtaccaccatactactcgtcggaccgacctaccgacgactaacttcttacgttttacccgtagaatagtcgtagttcgtggttacgacccggtccgcgtacggaccgtacgggttacgttttacgttacgttggtcggacgtaaggacgggacgttacttaagtttacgttagtttaggtttttagggtacggttttacggtttacgtttaccgtaacccttaccgtaacggtacgggtccggggtaccgggtaccgtacccgggtaccccgggtacggggaccggtaacgggttaacctaccggttcggttacccgtccggtttacccttccgttacccgtcccgtacccgtaacccggtaaccggtccctacggtccccggttcccttccccggacctccctacccccgtacgtacccgaacgtccgtacccg

SEQ ID NO: 143293 - DNA, 699 bp, Homo sapiens
  misc_feature: GYAE6OF02II1YR.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattggggtttggggagtctcggtcaggacacagcatggacatgagggtccccgctcagctcctggggctcctgctactctggctcgaggtgccagatgtgacatcgagctgaccagtctccatcctcctgtctgcaaccggtgggacgacagtgtcaccatcacttgccggnaagtcggaacattgactactatttaattgtatacaacatacgaccagggaccgcccctaagctacctaatctatgctgctactccgtagtttagacgtaaacggtcggggtacccagttcggtaaggttcaggtcggcgagtggtactcgtcgggaactaggtactttcaactctaccaccgtatcgtaattaacgtctacgacgtaaacggtgaaagtttactttacgaacttaaactttaacgttactacgttaaccaaagttaaacttaaatttaaacgtaacgttttacgggttttaacccgggaaaccgttaaacggggtaacccgtaaaccgtaaaccttaaaaccgttaaaaacgtttaaaaaccggtaaccgttacgggtacggtaccgttaacggtacctaaacccttacggttctttaacggttaacccttacgttaccggttcctaccccgtaccttacttcgtaacgttac

SEQ ID NO: 143294 - DNA, 872 bp, Homo sapiens
  misc_feature: GYAE6OF02GE9U8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttacggacgaccctgtccctcaccgtcgcgctgtcgtcgtggtcgccctccatcagttagttcggtttcttcgtggggtctcgggtccgcacgcctacccggaggggagggctagggtaactacgagttagggaagttcggtaccttccgtacgtagtagggttaggtacggtttaccttacgttacgtacggttacccgttctacctacgtaaggtcgtacgtacgttccaaccgtaattacttcgtcgttacggacctaccggttcccaggtacctaacttaccgtttaccgttttaccccgtaggaacgtagtttacggttacgttcgtacgggttaccgacccggtcccggtacgtacggaccggtacggggtttaccgtttttacgttacggttcggtaacggtcggtaacggtaacgggtaccggttacgttacgttttaaggttaggtttttacggtttttagggttacggttttacggtttaccgtttaccggtaaccctacccgttacggtaccgggtccggggtaccggggtccgtaccccgggtacccgggtacgggtaccggtaacgggtaacgttaccggtcgttacccggttaccgtaccgttacccgttacgtacccctaccgggaaccggtaacccggtacccgtacccgttcccggtttcccccgttcccgtacccggtaccttaccccccggtacgtaaccccgtaggtcccgtaaccccgg

SEQ ID NO: 143295 - DNA, 693 bp, Homo sapiens
  misc_feature: GYAE6OF02FQPJ9.46.67.G01.1.454.CMB.1.raw
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtcgccagagtgtgacatcgagctcgtacccgagtcctcctactcccttccctgtactgaccgaaccggtagggacgagagtcgtacaccctatcctacgttggcccgggtactaaggtaccggtaactaagttcgaacctaacctttaagttttaaagttcggtactaccaaactaagtacggtaaccgacgggtacccggaccccgttaacgccttacctaacttactntacggctnacgtactccttaggttcgaacgtaaggtcgggtcctacggtcggtagtactggtacggcgtaggtgacgttcgtagggacgttactacgtttactacctcctacnctaccgtactaagttacgtacgtacgacgtaaaccgtgtacttaacgtttgaaccttaactttattactagtaacgtaactacgtaaattacttaagttcgtttcgaaccgggtaggtaacctctaacgtaaacttaaataaccgtaagtcgtagacactaccgtcacttctgtttcctattcccgtaccgttccaccgtttactcgttagaacg

SEQ ID NO: 143296 - DNA, 729 bp, Homo sapiens
  misc_feature: GYAE6OF02H2TF6.46.67.G01.1.454.CMB.1.raw
  modified_base (133)..(133): a, c, t, g, unknown or other
  misc_feature (133)..(133): n is a, c, g, or t
  modified_base (138)..(138): a, c, t, g, unknown or other
  misc_feature (138)..(138): n is a, c, g, or t
  modified_base (156)..(156): a, c, t, g, unknown or other
  misc_feature (156)..(156): n is a, c, g, or t
  modified_base (430)..(430): a, c, t, g, unknown or other
  misc_feature (430)..(430): n is a, c, g, or t
  modified_base (582)..(582): a, c, t, g, unknown or other
  misc_feature (582)..(582): n is a, c, g, or t
tcagactagcagtacacgaccggtgctcgatttagagtatacatattgggtttggggagtctcggtcaggacacagcatggacatggagggtccccgctcagctccgtggggctcctgctactctggctcggnggtcnccagatgtgaccatcganctacgacccagtcctacctacttccctccgttgtcgtcgaccgtaaccggtggaagtacctaggtctacaccgacttacctacgttcggaccgggtacaacggtaccggaatcttagacctacgtttaattaagttgtaacacaacttaagacgaccggacgggacccgtaaccctacgtcctaaccgttataccgtacgtgtcctagaccttactaccgttttagttaccgaacgggtagggttacccggacctaaggttcggtaagttccgnggtcgtacggtacgtaggttacgtacggtggaaacttcgtactttacgcctttaaccgactaaccgtataacgtaacgttactaccgtacgtaccgtaagtacggttaacgttacgtttaccaacttaacgtttacttactaacgtactaanaatttacaattcgtacggttaccgacgttaacgtaactacgtaacttaagtaaactaaacggtccgtaagcgtacgaactaccgtacttacgtcgttaacttccgtaacttcccggtttacccactaccggtacttacgtaccgtag

SEQ ID NO: 143297 - DNA, 706 bp, Homo sapiens
  misc_feature: GYAE6OF02FG4IV.46.67.G01.1.454.CMB.1.raw
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttggacgaccctgtccctcacctgcgtctgtctcgtggtcncctccatcagtagtcgtttcttcgtcggggacttgggtccggcacgtcgtacccgaggggagggctaggtaatcgagttggtaagttcgtcttcctacagttacggtggtacggttccttaagttacgtacgtccggttctctacgaaggtacggtacgtagtaccaaccctagttacgttacgtacgttcggaactccgtacctacggactaacgttacgttaccgtttttaccccgaggtaacgtacgttgttacgtttcgtcgtaccgacccggtccgtacgtacgacggtaccggtacggttttactacgtcgtgaccggtagacgacgtactgtttagtattagtttacggtagttcgttacgttacgtacctaccgtagtacggtcggtacgggccgtacccgtccggtgggaccgtaagtacgtacggtacgtacgtccgttccttacgttccgtaccgaccaccggcgtaccgcgttcccggtcccttccgtccgtccctacccgtcctacgtacgaccgtcccg

SEQ ID NO: 143298 - DNA, 712 bp, Homo sapiens
  misc_feature: GYAE6OF02JADOP.46.67.G01.1.454.CMB.1.raw
  modified_base (265)..(265): a, c, t, g, unknown or other
  misc_feature (265)..(265): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgccaacggtgggagacagtgtccaccatcacttcggccgggacaagtcggaactagttgactaccttaatttaaattggtatacaanagtagaccgagggaccgcccctaacgctacctaatcttatgtcgtagcactcctaggtttagacgtaaagggtccgggtaccctagttaccggtaggttcgtacggtggtaccgtagggtacggtattcggtacgggaaccgtaaggttaactttccgtaacgttcctacccgtacctacgttactaacgttaactcgtacgtaacgtaacggtaggtaaacgtttattttacgtaaccttaaacgtttactttaacgttacgttaactaaacgtagttaaactttaacgttaacgtttcggttttaaccgggaccgttaacggtaacgtaaccgtaacgttaaacctaaaacgttaaacgtacgttacggtcgacgttacgacctacgttactcgttacttacgttaccgttacttacccgtacccgtaccgtacttccgtagtac

SEQ ID NO: 143299 - DNA, 829 bp, Homo sapiens
  misc_feature: GYAE6OF02H7D6A.46.67.G01.1.454.CMB.1.raw
  modified_base (139)..(139): a, c, t, g, unknown or other
  misc_feature (139)..(139): n is a, c, g, or t
  modified_base (285)..(285): a, c, t, g, unknown or other
  misc_feature (285)..(285): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctgggtnaccaactgcaggacgtccgggcccacgacgtggtggacgtccgttgggacaccctgtcccctagcctggctcttaggtcctcgtgggtctaccctccgataccgaggttacggttcggtttcctcggtggggcttaggggtcccgnacgtccgtacccgaggggaacgggtctaaggaactaccgtagttacggaaagttcggtactacgtactaagttacggtacgggtacgtttacccgtaattaaccggtacggttacccgttcgtaccgtaacgtaacgtacggtacgtacgtaccaacctaagttacctcgtacgtacggtaaccaccgttaccgaacggtacctaaacgttccgtttaaccgttttacccgaggtaaacgtgtttaaccggttagtttacgtaggtaccgacccggtccgtaagtccggtaacggtacggttacgtttaatacgtcggtagacgtacgaagtcgtacttaagtacgttagtttacgtttacgggtagttaccggttaacgttaccgaaacctacggttaaagtcccggttacgggaccgggggtttcctaacccggggtaacccggtaccggggtaaccggtaaagggttaacccgtaccggttaccgggttaacccgtaccggtttaccgtaacccgtttacccggacccgttaacccccggg

SEQ ID NO: 143300 - DNA, 944 bp, Homo sapiens
  misc_feature: GYAE6OF02JI1FL.46.67.G01.1.454.CMB.1.raw
  modified_base (145)..(145): a, c, t, g, unknown or other
  misc_feature (145)..(145): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtcgagggtcccttcggganaccccgtgtccccttcgacccttggccggtacctggtccttctcgggtcgccctccaatcccaggttacgttcgggtttcttcggtggggtccgttcgggggtccggccgacggtccttccccggaagggggaacgggggtcctgggtaaactaaccgtaggttaggaaaggttcgtccgttacctacgaagtaggttacgggtaaggtttacccttagttaaccgtaacggttccccgtcgtaccgttaacggtaaacggtaacggttccggaaccggttacctaacccgtaacttaacgttccgtcggttaacgggaactacccggttaccgactaactaactttcgtaaccgttttccccgtaaggaacgtgttctagtttccgtacgtaccggtaccggtacccgtcgtacgggaacctaggggttacccgttttacgttaaacgttcggtacgacggtaacggtaccggtaacgggtcttaagttacgttacggtttaagggtttagggaaggttttaccgggtttaattcccgtaaccgttaacccggttaaggtaaccgttcgggggaaccgggtaccggtacccgtaaccccggggtggtaacccggtaacggggtaacctccgttaccgggaccgttacccgggttacgttaccccgtttaaccgaccccgttccggaaaccccgggtacccgggtaccgtacccggttccccgttaccccgggttaccccttcccgggtaccccgttacccccgtaaccccgttaaccggtacccgtacctaaccccgg

SEQ ID NO: 143301 - DNA, 823 bp, Homo sapiens
  misc_feature: GYAE6OF02G5ADN.46.67.G01.1.454.CMB.1.raw
  modified_base (175)..(175): a, c, t, g, unknown or other
  misc_feature (175)..(175): n is a, c, g, or t
  modified_base (268)..(268): a, c, t, g, unknown or other
  misc_feature (268)..(268): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctcgtctcctgggtcncctccatcagtagttggtttcttcgtggggtcgtcggggtccggcacgtcctcccgaggggagggtctaggaatacagttggaagtgtctctnacttggtggtacggttctattacagtccgttctctcaagtacggtcgtaagtccacgtatatctcgtcgaaccgtacggtaccngacctaactctacgttttcccagtatagtgtacgtctgtcggacctccgcgtacggacgtacgggttctttaacgttacgtgtgacggacggtaaggaccggtatttaacgttgttaaggtttacgtttttaggggtacggtttacgggtttactttaaccggtaacccgttaacccgtaggtacggtccgggggtaccggggtaccgttaaacccggccccccgggggttaggggaccccggtaaggggttaaacgttacccgttggggttaccccgttaaccccgggttaccgttacccggttttaccggtaccccttaaccccgggtaaacccggtaaccccggggtaacccccgttaccggtttaaccccggggtttccccccccggttacccccgttaccgggttaaccccccgtttacccccttaccccgggtaaacccgttaccggccccgttaaacccccggg

SEQ ID NO: 143302 - DNA, 736 bp, Homo sapiens
  misc_feature: GYAE6OF02JO36X.46.67.G01.1.454.CMB.1.raw
  modified_base (285)..(285): a, c, t, g, unknown or other
  misc_feature (285)..(285): n is a, c, g, or t
  modified_base (649)..(649): a, c, t, g, unknown or other
  misc_feature (649)..(649): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtgggacgacagtgtcaccatcacttggccggcaacggtcggaacattacgactaccttatttaaacgtgtatcaacatagacgaggaccgccctaanctactatctatgctgctacgtctagttcgacgaacggtcgggtacctagtcgtacggtactaggtggactaggtagtactcggtagggatacggtacttacgtaccttacctacacccgtattaaccgtagttaacgttacgtacggtaacgtaaaccggtgtaaaacgtttagttttaacgaaccgtttaaactttaacgtttaacgttaccgttaaacggtaaaaccttaacgttaaaagtttaaacctaacggttttacgtttttaaccgggaaccgtaaacgggtaccgttaaaccgtaaaccgtttaaaaccgttaaaaccgttaaaacgtaaacccggtttacgtaacggtccgttanaccccgttaccttaacgttcgttaccgttaccgttaccgttaccttttcccgtacccggtacccttaactttcccgttaaggtaccc

SEQ ID NO: 143303 - DNA, 1006 bp, Homo sapiens
  misc_feature: GYAE6OF02I5VF2.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgagggagtcgggcccacgactgggtgaggccttcgggacgacccctgtcccctacaccgtgcgtcctgtcctcgttgggtcgccctccatccgtaggttaggttcggttttccttccgggtgggggtccgttcggggggtcccggactacggtccccgtaccccggggaagggggaaccggggggtcttaagggtaaacttaccgtaggtttagggaaggttccgttccttacgttacgtaaggtttagggttacggggtaacggtttacccttaacgtttaaccgtacgggttcccgttacgtaccttacgtaaacgggtacgttaccggtacgttaccgtaaccctaagtttaccgtcccgttaaccggtacgggtaacccctaaccggttaccaaggtaaccttaaaccgtttaccgtttaaccgtttttaccccggaaggtaaaacggtacgttttacggtaaccggttttcgtaacgggttacccggtaaccccgggtcccgggttacgtacgggtaacccggttaaccggggtttacttttaacgttacgggtagttacgggaaccgggtaagggtaccggtaaccggtacttttaaagggtttacgtttaggttttaacgggtttttacggggtaaggtttttacgggttttaacccgtttaccggtaaccccgttaaaccggttaacgggtaccgggttacccgggggtacccgggggtccctttacccccggggggtaaccccgggttcgggggtacccggtaaacggggtttaaacttccggggttacccggttcccggttaaccccggttacccggttttacccgtacccggttaccccgtaaccccggg

SEQ ID NO: 143304 - DNA, 624 bp, Homo sapiens
  misc_feature: GYAE6OF02GCM6J.46.67.G01.1.454.CMB.1.raw
  modified_base (389)..(389): a, c, t, g, unknown or other
  misc_feature (389)..(389): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaatggtatcaacatagaccagggacgcccctaagctacctaatctatgctgcatccagtttgactaaaggtcgggtcccagtcgtaggttcaggtgctagtggatcgtagggacagtactttcacttctcacctatactacgtaactntacgacgtaagtagtaaagttattttcgaactaacgtttattacgttacgtacaaacgttagtaaactttaacctaagtttacggttttacggaaccgtaagggtacctaaacgtaaccttaaacgtaaaacgtttaaaacgtaccgttagttacggtactacggtacctaaccgtacttccgttaacgtcctttactacctttccgttacccggctaacgttccgtattaaccg

SEQ ID NO: 143305 - DNA, 806 bp, Homo sapiens
  misc_feature: GYAE6OF02GK5W3.46.67.G01.1.454.CMB.1.raw
  modified_base (276)..(276): a, c, t, g, unknown or other
  misc_feature (276)..(276): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgccgctgtctcgtggtcgcctccatcaggtagttggtttcttcgtgggtctggggtcccgcacgccgtacccgaggggaacgggtctaggaactctagttagggagttcgtcctcctanagttaggtggtacgttccttattacgacggttcccgttctacctacaaggtacgtcggtacgttccgaacctacttacgtcctccgttacggaacctaccggtacccagtaacctaacgttaccgttaccgttttaccccgtaggtaaactacggttcggttacgtttccgtacgggttacccgtaccccgggtcccgttacgtaccggtaaccgggttaccgggggttttacttttaacgtttacgtacgggtggtacgggaccggtaaggtaccgttattaacgtttagttacggttttaggttttagggttaccggtttaggttccgtttaacgtaccgtaccttacggacgtcgggtaccgggtaccgtacccggtcccgggaggtacccggtagggtactaccggtcgtaacctcccggttcgttaccgtaccgtacccaccgtaacccggcggtaccctacggttcccgttacccgtccccgtccgtccccgtaccctacccgtaccgaacgtccgtaaccccg

SEQ ID NO: 143306 - DNA, 737 bp, Homo sapiens
  misc_feature: GYAE6OF02FO3X1.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctgacccagtctccatccctccctgtctgccaccgtggagacngtgtccaccatcctacgttcggccgggactaacggtaccgggaactagtttcgaacctaacctttaattttaaaagttcggtactacaaacaagtaacgaccgaagggaccggacccctaagccttacctaatctatcgtctgctacgtccgtaggtttagggtaaacggttcgggtacctagttacggtacggttacgtacgggtcgggtacaggtggtacgtcggtaacgggacgtagtacttctactcgtaccactatcgtaatatctacgactaacgtagtagttactttacgtacttaactttagttacgttacgtacgaaacttagttaacgttaccgttaagtttaccgggtttaccggaaccggtaacggtaaccgtaaccgttaaaccgttaaacgttaaaccgtttaaaccgtacggtacggttaccgtcgttaccgtacccttaccgtaactttccggttaccggttccttttaaaccgtcccgtttccccttacccggtaccgtttaccgttcgttaccgttacgttaccg

SEQ ID NO: 143307 - DNA, 737 bp, Homo sapiens
  misc_feature: GYAE6OF02I3R60.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttggggagtctcggtcaggacacagcatggacagtgagggtccccgctcagctcctggggctcctgctactctggctccggaggtgccagatgtgacatcgagctgacccagtcctccatccctccctgttcctgcaaccggtggganacagtgtacaccatctacgttcggccgggactaaggtcgaactattcgacctaccttaagttttaacttggtatacaacatacgaccgacgggaccgacccctaagcctacctaacgtctatcgtactgctactccgtagtttacgacgtaaacgggttccggggtaccctaagttcggttacggttacgtagggtacggtcgtaggtacgggttacgttaccggtacggggtaacctaggtttacgtttaccaccttcctaccctaacctactacgtaacgtttaacgtcgttacggaaccgtaacggtaagtaacggtttagtttacgaacgtttaaactttactttacgttacgaaccttaaacgacgtaaactttacgttaacgtttacggtttaccggaaccgaaccggtaccaaccgttaactaaacgtaaacttaaaccgtagttacggtcgacttacgacctaacgttcttacgttccgttacttaccgttaccgttacccgtaccctaccgtattacctaggttaaccg

SEQ ID NO: 143308 - DNA, 672 bp, Homo sapiens
  misc_feature: GYAE6OF02I0MCP.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcgagtagttggtttcttcgtgggctgggtccggcagctcccgaagggagggctaggaatacagttaggaagtgtctctcatagtggaggttcctattacgagtaccgtctctacaagagtcgagtccacatactctcgtggacacgtccagctaactacttagttttaccctagaacgtatgacgtttctggtacgaccggtcgctacggtacgcggtacgttttattacgtgttcgacggagacggacgtcgttattaagttcgtttagttttaggtacggtttagtttacgttacgtaaccgttaccgtacgtacgtcggtacgggtccgtaccggacccggtcgggaccgaacgggtaattccggtacgtccgtaccgttcgttacgttacccgtctaccgaacccgtacggaaccccttacgtcccggttacccgttcccccggtacgtacccgtaaccccttcccgtaccgaaccggtccgtaacccgg

SEQ ID NO: 143309 - DNA, 863 bp, Homo sapiens
  misc_feature: GYAE6OF02FX0SN.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggagtcgggccacgtactggtgacggccttcggagaccccttgtccctacaccgtgcgtactcgtctctggtcnccctcactcaagtcgttgtttctgtgggcgtcgggtccgcacgtccgtaccggaggggagggtcgtaggaactactaggtttaggaagtgtctacgtctaagtggttacggtacggttaccgttacgttaccgtaacggttcccgtccttacgtaacctaggtacgttccggtaacgttaccgaacctagttaacttcctacgtacggtaccgtaaccgttaccgaacaccgtaattaccgtttaccgtttaacccgtaaggtaacgtaacgtcgttacgtttacgtacgtaccggtaccccggtccggtacgttacggaccggttacggggttacgttttacgttaccgttaggttacgtacggtacggtacgggtacgtactttaagtttacggttagtttagggttttaggttaacggttttacgggttttaacgttttacccgaacccttaaccgggttacgtaaccggggttacggggttaccccggggtaaccgttccccggggttaaacccggggttacccgggggttaaccgggttaaaccgggttaaaccgtttaccggggttaaccccgtttacccggtaacccggtttaccccgttttaccggttacccccgtacccccggtttaaaccccgg

SEQ ID NO: 143310 - DNA, 680 bp, Homo sapiens
  misc_feature: GYAE6OF02F1M4N.46.67.G01.1.454.CMB.1.raw
  modified_base (265)..(265): a, c, t, g, unknown or other
  misc_feature (265)..(265): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggcccttcgggacgacccctgtcccctcaccctggccgctgtctcgtggtcgccctccatcgagtagttggtttctcgtggggctggggtccgnacgcctccgaggggacgggctaggaactacgagttggagtcgtctctctagtaggtggtagttccttattacgacgtccgtctcgtacgaagtacgtcgactaccactatactctcgtacgaccaccgtccagactaactcttaccgtttccagacgtatcgtacgttcgtcgtcggacccgccgtacgtacggtaccggtaccgggttacgtttaacgtacgtggtacggcggtagacggtacgtacgttattagttgttagttttgggagtttggttactttacgacttaccgtagtacgggttaccgggtccgggtcctacccgggtcccgggtacggggtaccgtaagggttacttacggttccggtaccgtacccggttccgtacccgttaccggtacccctaaccccgg

SEQ ID NO: 143311 - DNA, 879 bp, Homo sapiens
  misc_feature: GYAE6OF02IYPCT.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgacctgtccctcacctgccgctgtcgtctggtcgcctcatcagtgtcgttctcgtgggctggtccgcagctccgagggagggctaggtaactacgagttggaagtggtctcgtactagttgtcgggtacgggtttaccttagttaccggtacgttaccggtcctaccgtacaaaggtacgtccggtaaaggtccctaaaccagttaacctttcccggtacgttacggggtaacccgtaccgtaccgtaaacgggaacctaaacgtttccgtttaaccggtttttccccgaagggtaaaccgtacgtttacggttacgttttaccggttacggttaccgggtaccccggtaccccggttaccggttacggttaaacccgggtacggggtttaacccggtttttaaacggttttacgtaaccgggtttcgtaacccgggtaacgggtaacgggtaaccggttaccgttttaatttaacgggtttcgttttaaagggttttttttcgggaaacggttttgggtttttaacgttttaccgttaacccgttacccggttaacggttaccgtaaccgggggtaccgggggttacccgtacccgggtaaccccgggttacggggacccgggtaacgggtaacgttaccgggttccgggttaccgtacccggttccgtttaccgtttacccggtcccgttaacccgg

SEQ ID NO: 143312 - DNA, 807 bp, Homo sapiens
  misc_feature: GYAE6OF02JRS2V.46.67.G01.1.454.CMB.1.raw
  modified_base (504)..(504): a, c, t, g, unknown or other
  misc_feature (504)..(504): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgacgtggtgaggtccttcggagtaccctgtccctcaccgtgcgtctggtctcgtggtcgcctccatccagtagttcggtttcttcggtggggtccgttcggggtacccggcgtacgtccgtccccggtaaggggggaacgggtcctacgggtaactacgaggtttaacggagttacggttcctactacggtaagttacggttggggtaacggtttcccttaagttaaccgtaggttccccgttacttaccgtacggaagttaacggtccggtaacggttacccaacccgttaagtaccgtccggttaccgtacggtacccgtaaccgtccgacgtaaccgttaatcgttaccgttttccgaagtagtagtacgtacgtttacgngtccgtaccgcgtcgtcgacgtacgggtactttacgtacgtggacgagtacggaggtacgtactttagttagtagttcgtttaaggagtttacggttacgttcgaacttacccgtaggtaaccggttcgggaccggtccggacccggtccggtcgggacgtaacgggtcgttaccgtgccgtccgttaccttcgtaccgacccttccggtaaccgaaccggggttccctaggttacccggttcccttcccgggtacccgtacccgtaccccctacggtttaacccaaggttccccgtaaccgg

SEQ ID NO: 143313 - DNA, 860 bp, Homo sapiens
  misc_feature: GYAE6OF02F51PM.46.67.G01.1.454.CMB.1.raw
  modified_base (163)..(163): a, c, t, g, unknown or other
  misc_feature (163)..(163): n is a, c, g, or t
  modified_base (201)..(201): a, c, t, g, unknown or other
  misc_feature (201)..(201): n is a, c, g, or t
  modified_base (592)..(592): a, c, t, g, unknown or other
  misc_feature (592)..(592): n is a, c, g, or t
  modified_base (737)..(737): a, c, t, g, unknown or other
  misc_feature (737)..(737): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtagacatcgagctcgaaccngtcctaccactccctccctgtctagcaaccggtggganacgtagtcgtacactactctaacgttcggaccgggacaaggttccggaaactacgtttacggaactaacccgtttaaagttttaaaaacgttcgggttaactaacctaaaacgtaacgttaacggtaaacccggtaaacggggggaaaccccgtaccccccgtttaaaacgggaccctttaaacccggttaaaactttaccccgttaaagttccgggtaaccgtttacggaaccttaaccgtttaccccgtaaggtttttacggaaaccggtaaaagggtttcccgggggttaaccctaaagttccgggtaacggtttaccagggttacggacgttaagggtcgtaacgttacggacgggtaacagttaacttcgaacttctaccaactanaacgtagttaatacgtagacctaaggtagtagtttacgttacgaacttaacttacttaaccgtacgttaacaaagaacgttaaacttactaagtttaccggggtttacaaccgtaaccgggtaacttaaccggtaaaccttaaanaaaacccgtttaaaggtaacctggtaagtacccgtataccgttaaccgatttcccgttaaccttacgtttaccctttaacgttacccgtcccccgaacgtttaacttaccggtactaaaccgg

SEQ ID NO: 143314 - DNA, 711 bp, Homo sapiens
  misc_feature: GYAE6OF02GSEUG.46.67.G01.1.454.CMB.1.raw
  modified_base (172)..(172): a, c, t, g, unknown or other
  misc_feature (172)..(172): n is a, c, g, or t
  modified_base (206)..(206): a, c, t, g, unknown or other
  misc_feature (206)..(206): n is a, c, g, or t
  modified_base (252)..(252): a, c, t, g, unknown or other
  misc_feature (252)..(252): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcgggagacccctgtccctcacctgcgctgtctctggtncctcatcagtgtgtttctcgtgggctgggtccgnagcctccgaggggacgggctggaactacagttggaagtcgtctctnagttaggtggtaggttccttattacgacgtccgtctctacaagtagtcgatccacctattactctcgtggacctacgtccagcaatcctacgttttccccgagtaagattgacgtttctggtcgaccggccgcgtgaaccgtcgggttacttttatcgtgtcggtcgaaggacgtacgggtcttagtttacttaggtttacgtttttagggtaggtttaggttttacgtttaccgtaacctacccggttaagtaccggtccggggtaccgggggtcctcccgggtaccccgggtcgggaccgtaacggggtaacgttcggttacgtacccgtacccgttcttacccgtactaccccgtacccgacggaaccggtccccacgggtttccccgttaccccgtttccccccggttcggacccccttaccccgttaccccgtaccgaacggtacctaccccgg

SEQ ID NO: 143315 - DNA, 769 bp, Homo sapiens
  misc_feature: GYAE6OF02G7PT3.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggccccacgactggtgaggccctttcggacgacccctgtccctcacctgccgtctgtctgtggcgccctacactcgagtagttggtttccttaggtcgggtcgtacgggtcccgcacgtcctaccggaggggtaaggctaggaatcgagttggaagttcgtacttctagtagtaggtaggttacggtttcctaattaccgtacgggttccctctaccgttacgaaacggttcggtaccggtaccgtacctaaaccctagttaccttcttcccggaaggtaccctaccgtaccgaacgactaacgttccgtttaccggttttacccaaggaacttgtacggtacgtttccgaggtacccgcccggtcgacggttacggtacccgtacggtttagtttaacctttcggtaggtcgaacgggtagaacggtaaccggtattttaagttagttaggtttagttttgggtaggttttacgtttacgttacgaccctacgttatacgggaccgggtccggccgtcccgaccgggtagggaccgtagacgttcggcttaccgtaccctcgtcttaccgccctaccggaacgtaccggtccctaggttccccgtccccgttcccgtacgccccttacccgtccgtaacggacgtcctaccccgg

SEQ ID NO: 143316 - DNA, 801 bp, Homo sapiens
  misc_feature: GYAE6OF02JFP39.46.67.G01.1.454.CMB.1.raw
  modified_base (141)..(141): a, c, t, g, unknown or other
  misc_feature (141)..(141): n is a, c, g, or t
  modified_base (400)..(400): a, c, t, g, unknown or other
  misc_feature (400)..(400): n is a, c, g, or t
tcagactagcagtacacgaccggtgctcgatttagagtatacatattgggtttgtcctcctgctggtgcagctcccagatgggtcctgtccctggtgcaactgcaggagtcgggcccacgactggtgaggtccttcggganaccctgtccctcacctgcgctgtctctggtcgcctaccatcaagttgttcggtttcttccggtggggtcttcggggtacccggctaggcccttacccggaggggggtaagggggcctagggaaactacgtacggtttacgggaacttggttccttctacgtaagttaaggtcggtaggttaccttattacgacgttccgtctctaacgtaagcgtcgagttccaacctatacttcgtacgtacgacctaccgtaccganacctaacgttcttaccggtttttcccgaagtaaacgtgttcgttacgttccgttagggtcccggaccggtccgacgtcggtaaccgacgggtttattttactcggtagtcgacggagggtaacgtcggttacttaaatttcgttagtttaacgttttaggacggtttggtttacttaccggtaaccctaccgttaacgacgttccgggtaccggggtccgtacccgggtaacccgggtcgggtaaccggtacgggtaaaccttacgggtttaccggtaccctaaccggttcccttaacgtttaccccgtcccttacccggacccggtaaccggcccttaccggttcccgttacccgttcccccgcgtacccctaccccttccgaccgtacgcccgtacccg

SEQ ID NO: 143317 - DNA, 751 bp, Homo sapiens
  misc_feature: GYAE6OF02G0DH2.46.67.G01.1.454.CMB.1.raw
  modified_base (739)..(739): a, c, t, g, unknown or other
  misc_feature (739)..(739): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgaccctagtcctccattccctcccttgtctcgacctaacggtgggaacgaccgtaggttcgacctaccgactaccgtacgttcgggcccgggtacgtaacgggtaccgggaaactagtttacgaacccgtaaccctttaagttttaaacggtttacggtaattaacctaaacgtaacgtaacgaacccgggtaaccgggggacccggtaccccgtaaacgtcccgttacccttaaacttcgtaatcgtaccgtcgtctaaccgtcgtagtttacgacgtaacggtcgggtaccctagtaccgtaggttacgaggtcggacgtaggtacgtacggtacgtagggactagttacttctactacgtacctactacgtactaagttactacgtacgtaacgtacgtagtaactttacgtttcttaacgtaactttatacttacgtactaacttaaactacgtttaaacgttagtttaccggttacggaaccgtacggaaccgtaacgttaacaaacggtaaaactaccggaagttacgtcgtacgttacgacctagtactcgttactccttcgtacctctccgtacncttacgtatacg

SEQ ID NO: 143318 - DNA, 937 bp, Homo sapiens
  misc_feature: GYAE6OF02GELLO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctcactcctcctgtctgcaaccggtggagacagtcgtacaccatcctacgttcggacccggggtactaaacgggttaccgggaaactacgttttacggaaccctaacccgttttaaagtttttaaaaacgtttcggggttaaactttaccgaaaacctaacgttaaacgggaaccccggtaaggggggaacccccgggtaacccccccgttaaaacgggtcccgtttaaccccccttaaaaggttacccttaacgtttaccgtccggtttacgggacccttaacgttacccccgtttaaggttttaccggaaccggttaaaaacgggttccggggggtttaaccccccaaggtttaccgggtaaccggggtttaccgtaagggtttacggggaccgtaagggttacggggtagtaccggttacgggggaaacgtacgtttaaccgttttccgaacctttacccgtacctaaccctaacgtttaccggtaaaccgttaacttaccggtacggtaaacccgttaaaccgggttaagtaaacggtttagttttaacggaccctttaaacggtttacttttaaccggttacttaaccgtaaaactacggttaaacttaaccgtagtttacgtttaaccgggacgtaaacggtacctaacggtaaccgttaaagtaaaccgttaaacggtatacgggtagtccgttagacccgtaacgtacttacgttcgttaaccttcctaccgtttcccgttccaccgttaactccgttagttaaccg

SEQ ID NO: 143319 - DNA, 878 bp, Homo sapiens
  misc_feature: GYAE6OF02F37MF.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtccggcccacgactggtgaggccttcggagaccctgtccctcacctgcgctgtctctggtcncctcatcagtgtggtttctcgtgggctcgggtccgcagcctccgaggggaagggtcctaggaactacgagttcgggaagtcgttctctactagttagtaggtacggtttacctaagttacctagtccccgttctcctacgaagtcggtacgtaacgtcaaccgtaattacttcgtacgtacggtacctaaccggttaccgaacgtaccgtaagtttccgttaaccggttttttaccccaggtaaaacgttacgttacgttaacgtttccgtaggttaccgacccggtcccggtacgtttaccggaaccggtacggggttacctttttaacggttaccgttagggtacgtacggtacgtaaccggacggtttaccgtaagtttacgttaggtttaacggtttttacgggtaggtttacggttttaactttaccggaacccttaaacgggttacgtaaacggtcggggttaacccgggggtccttaacccgggtaaccccgggttacgggggtaaccctaaaacggggttaaaccttaccgggtttaccgggtacccgtaaccccggttaccttacccggtttaccgtaccccgtaaccgtaacccgggtaaaccggtccccgttaacggttaccccggttcccgtttaaccccccggtgggtacccccttaccccgttacccgaaccgtaaccggtacccgtacccg

SEQ ID NO: 143320 - DNA, 880 bp, Homo sapiens
  misc_feature: GYAE6OF02GEXIZ.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggcctccgaggtgccagagttgtgacagtcgagctcgacccagtcctccactccctccctgtctcgacgaaccggtggagacagtcgtaccaccactcctacgttcggacccgggactaacggtaccggaactacgttacggaacctaaccgtttaaattttaaacgttcggttaactaccgtaaaactaacgtaacggaacccggtaacggggtaccccggacccccgttaaggtaccccttaaccgtaacttaccttagtcgtcgttacggtacctacgttacccgttaggtttaccggtaacgttaaaccggggttcggggttacccctaaggttacccgggttaacggtttcggaaggttccggtaagtacggttcgggtacgttaccggtagggggtactaacggtttactttcccgtaaccgttccctaccgtaaccgtacttaccgttaagtttaacctttaccggtacggtaaaccccgttaaaggttacggttaaaccgttttaagttttacgtaaccttttaaaccgttttaacgttaccgttacgtaaaccgtaaaacgtttaacgttaacgttttaaaccttagggttttaacccgggttttccggaaaccggttaaacgggtccctaaaggttaaccctaaaccgtaaaacggtttaaaccgaacgtacggttacgtacgtacctactacctcgtacttcgtacctacgttccctaccttcccaacgtcgtaccgtatacccg

SEQ ID NO: 143321 - DNA, 634 bp, Homo sapiens
  misc_feature: GYAE6OF02FN665.46.67.G01.1.454.CMB.1.raw
  modified_base (254)..(254): a, c, t, g, unknown or other
  misc_feature (254)..(254): n is a, c, g, or t
  modified_base (482)..(482): a, c, t, g, unknown or other
  misc_feature (482)..(482): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgccgctgtctctggtcgcctcatcagtagttggtttctcgtggggtctggggtccgnagcctccgagggagggctggaatacagttggaagtgtctctcatagtggtacggttcctattacgagtccgtctctacaagagtcgacgtcacatactctcgtacggactaccgtcacgtactagtacctacgttttaccctaggtaactacgtggtagtttctcggtcgacccggcgtcgtgaccgtcgggttactttagttactggttgacgacggtacggacgtnttacttagtagttagttttagggtgtttagttactttacgaccgtactagtacgtcgggtaccgggtccacccggtacccggtagggcccgtaaggtacgtaacggttccggtcctacggtttccctacgttacccggtaccctaaccccgg

SEQ ID NO: 143322 - DNA, 736 bp, Homo sapiens
  misc_feature: GYAE6OF02HRHCD.46.67.G01.1.454.CMB.1.raw
  modified_base (262)..(262): a, c, t, g, unknown or other
  misc_feature (262)..(262): n is a, c, g, or t
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagttaggttggtttccttcgtgggggtcttcggggtcccggnacgtcctaccccggaggggaacgggggctacggaaatacagttggaagtgtcctntcagtagtggtaggttcctaattacgagtccgtctctacaagngtacgagttaccacctatactctctaggacacgtccaagtcaattctacttttcccgagtacgaagtgtaacgtttctacgtcgacccggccgtacgtacgacgtacggggttacgttttaacgttacgtggttcgtacgtacggtacgggacgtacgtttaaagttcgttaggtttacggtttttttgggaacgggttttagttttaacgttttaccggtaacccgttaaccgttaacgtaacgttaccgggggtaccgggggtccgttaccccgggtaaccccgggtaccggggtaccggtaaacgggttaaccgtacggttacgggttacccgtacccggttcctttaccggttacctccccgttaaccccgg

SEQ ID NO: 143323 - DNA, 885 bp, Homo sapiens
  misc_feature: GYAE6OF02JDEYE.46.67.G01.1.454.CMB.1.raw
  modified_base (789)..(789): a, c, t, g, unknown or other
  misc_feature (789)..(789): n is a, c, g, or t
tcagactagcagtacacgaccggtgctcgatttagagtatacatattgggtttggggagtctcggtcaggacacagcatggacatgagggtccccgctcagctccgtggggctcctgctactctggcctccggaggtgccagatgtgacagtcgagtctcgacccagtcctccatccctccctgtctcgacgtaaccggtgggacgacaggttctaccgaccctatcgtaactttcgggccgggactaaacggtccgggaactacgtttcggaacctaacctttaattttaaacgttggtaacttaccgaaactacggtaacgacccggacggggaacccggtaccccttaaagcccgttacctaaattacccgttaagtcggtaccccgtagtcctaacgttccgttacgggtttacaaccggtaaagggtttcccggggaaacctacggttaccgggtaacgggttttacgaacgggttccggaacgttaacggggttcggttaaacgtccggggttacgggtaaccgttagtttaaccgttttacccgaacctttaccgttcccgtaaaaccttcggttaaacccgttagttaaccgttcggttaccggaacgttaaacggttctaaacggtttacgtttacgaacccgttaaacgtttaccttaccggttaaagtttaacccgaaaacggttacgtttaaaacttacggtaaaccgtttttcggggttaaacccgtaccgaaagggtacccaacctttaaaccgtaaacaaacgttttaaaccgngtttaccgtacggtcaaaccgttccaaacggtaccttaccgtcttaaccgtttcggtactttccccgtaccgatttaccgttacgtattaaccccg

SEQ ID NO: 143324 - DNA, 686 bp, Homo sapiens
  misc_feature: GYAE6OF02H31KA.46.67.G01.1.454.CMB.1.raw
  modified_base (97)..(97): a, c, t, g, unknown or other
  misc_feature (97)..(97): n is a, c, g, or t
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
tcagactagcagtacacgaccggtgctcgatttagagtatacatattgggtttggggagtctcggtcaggacacagcatggacatgagggtccccgntcagctcctggggctcctgctactctggctcgaggtgccagatgtgacatcgagctgaccagtctccatcctcctgtctgcaaccgtggacncagtgtcaccatcacttgaccggnaagtcggaanttgacncttattaatggtancaacatagaccaggacggccctaagctacctatctatagtctgcactcctagtttacgacaaaggtcggggtaccctaagtccggttaaaggtttccaagggttcggaccgtagggttacggtactacgtacggggttaacaggtaacttttccaacttccgtacaaccctagttaacacggtaattctaacgtcgtaacgtaggtaaagtacgttttaaggtaactttacttaagttacgtctaaacgtaagtaaatttaacaagttacggtttttaaccggactaaacggggtaacgtaacgtaaaacggttaaactaaaacgttaaaccggttaaaaactttcggaacggtacgtagtaccgtacaacgtttacgtacgttaacgttcctaacgtttaccggttaccctaccgtaactttaccgttaggtacttaaccgg

SEQ ID NO: 143325 - DNA, 802 bp, Homo sapiens
  misc_feature: GYAE6OF02I3Y6W.46.67.G01.1.454.CMB.1.raw
  modified_base (213)..(213): a, c, t, g, unknown or other
  misc_feature (213)..(213): n is a, c, g, or t
  modified_base (394)..(394): a, c, t, g, unknown or other
  misc_feature (394)..(394): n is a, c, g, or t
  modified_base (442)..(442): a, c, t, g, unknown or other
  misc_feature (442)..(442): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccggccagactggtgaggtccttcggacgaccctgtccctcacctgcgctgtctcgtggtcncctcactacgtagttacgttggtttccttcgtgggggtcttcgggggtcccgacgtacgccgtcccggaaggggtaacggggtccgtaggtaaacttcgtaagtttagggaacgttcgtaccttctacgtaagttaggttacggtcggttaccttagttaccgaacgttccgtctacgtanaaggtacgttcgtacgtccaaccgttatacgttcctcgtacggtaacncccgttaccagacttaatcccgtttacgttttcccaagtacgtagtacgttacgttcgtacgttaccgccgtccgtacgtaacggtaccggttacgggtttaccttttagtttaccgtgtacggacgtaacggtaacggtaccggttaacttacgtttaagtttacggttttaggtttttacggggtagtttttacgggtttacctttacccggttaaacctaacccggttaagtaccgttacccggggtacgggtacctaccccggggtacccggttaccgggaaaccggtacggttacgttaaccgtcgggttacccctacccggttacgttcccgttaccgacccttaacccccggg

SEQ ID NO: 143326 - DNA, 719 bp, Homo sapiens
  misc_feature: GYAE6OF02JKXKH.46.67.G01.1.454.CMB.1.raw
  modified_base (128)..(128): a, c, t, g, unknown or other
  misc_feature (128)..(128): n is a, c, g, or t
  modified_base (137)..(137): a, c, t, g, unknown or other
  misc_feature (137)..(137): n is a, c, g, or t
  modified_base (199)..(199): a, c, t, g, unknown or other
  misc_feature (199)..(199): n is a, c, g, or t
  modified_base (433)..(433): a, c, t, g, unknown or other
  misc_feature (433)..(433): n is a, c, g, or t
  modified_base (529)..(529): a, c, t, g, unknown or other
  misc_feature (529)..(529): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtccngtcctggtncaactgcaggacgtcggccacgactgggtgaggccgttacggaacgcctcgtccctctaccnggtaccgcttcgttacctcgttacgggtctcccctacagtcgtaggttacgttcggttttccgtcggtcggggtcgtacggggtccgcgaggtccctaccggggaggggtaacgggtcgtaggaacttacgaggttagtaggtcgtactcgactaagtggtacggtacttacgtaagtcgagtccgttacttccgtagaacgtagtcgtacgaactacctatacttccgtacgngtaaccgcgttacagacgtattcgttaacttccgagagtacttaggtcgtcgtacggtaccgccgtaccgtcgtaggaacggtcgggttattttancgtacggtagtacggtaagacggtacgttacgttacgttagttccgtttagttttaggcgtttaacggttcttccggtaaccttaggtaaccggtcgtacgggtcccggatcccgggtaaacgggtcggacgtaaacggtacgttacgacgttccggaccgtttaccgtccgtaccgttacccgacccgg

SEQ ID NO: 143327 - DNA, 721 bp, Homo sapiens
  misc_feature: GYAE6OF02GW4EX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtcgcagtatgtgacatcggagctgacccagtcctccatcctcctgtctcgactaaccggtgggaacacgtacggtgtacaaccgtatacctacgttcggccgggacaaggtcggaacattcggaacctaccttaatttaagtcggtaactacaactatacgacgacggaaccgcctaagcctactaatcgtagtcgacgtcacacgtacctaggttacgacgtaacgggtccggtacctagtcggtaacgttcgacgggttacgacgtagggtacggacttacgggtacgggaacttaacgtcggtttaacacccgttacgtaccgaactaacgttaccgaatttaacgtccgtacgacgtaacggtagtaattactttcgaacttaacgttacgtacgtatacgaactaagtacttaacgtacggtttacgtacccggaagtaacggtactaaacccgtacttaaaacgggtaacttaaacggtacgttacggtacgtacgtacgaaccggtttaacgaagtttcccggttatacccgttacgttaccgttaccccgtacggtaaccttcgggttctaaccgtacgg

SEQ ID NO: 143328 - DNA, 665 bp, Homo sapiens
  misc_feature: GYAE6OF02JZQCO.46.67.G01.1.454.CMB.1.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (380)..(380): a, c, t, g, unknown or other
  misc_feature (380)..(380): n is a, c, g, or t
  modified_base (528)..(528): a, c, t, g, unknown or other
  misc_feature (528)..(528): n is a, c, g, or t
tcagactagcagtacacgaccggtgctcgatttagagtatacatattgggtttgggggacctcctgtgcaagaacatgaagcacctgtggtttgtcctccgtgctggtggcaactcccagatgggtcctgtccctggtgcaactgacaggtacgtcggcccagtactggtgaggccttcggagtacccctgtccctcaccgtgcgctgctctggtacncctcatcaagtgtcgttctcgngggactgggtccgnagcctccgaggggaggctaggaatacgtgttacggaatcgtactcgtactaggttaacgtggacggtttcctaagtttaccgagttccggttctctacgaaagtcgtacgtagtccacgtatatcncgtagactacgtccagtccaagtctacgtttccagaatctggtactctaggttcgaccgtcgacgtacgacgtacgggttactttaacgttcgtacgttcggtacgtagaccggtacgtattacgttaagttgttagtttttaagggnttttacgggtttaactccggtaacctcggtacgtaacgtcgggtaccgggttcgtacccggtaccggtcgggaaccgtaggtaactccggttagggcccttacggtacctcccggttacgtacccgtccgtaaccgg

SEQ ID NO: 143329 - DNA, 912 bp, Homo sapiens
  misc_feature: GYAE6OF02HBIID.46.67.G01.1.454.CMB.1.raw
  modified_base (210)..(210): a, c, t, g, unknown or other
  misc_feature (210)..(210): n is a, c, g, or t
  modified_base (442)..(442): a, c, t, g, unknown or other
  misc_feature (442)..(442): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgccaactgcaggagtccgggcccacgactggtgaggccttcggacgaccctgtcccctcacctgcgctgtctntggtcgcctccatcagttagttgtttcttcgtcggggtcttcggggtccgacacgtcctacccggaagggggacgggctaggtaaacgtactagttaggaacgttgttaccgtatcaagttagggtacggggttacgttacccttaagttaaccgacggtttcccgtacttccgtaaccgtaaacgtacggtcgtaacgtccaacctattaactccgttagtacggtaaccnccgttacaacgtacctaaacgttcgtttaccgttttaacccgaggaaacgttacgttaggttaccgtttcgttacggtaccggtacccccgtaccggtccgttaaccggtaacgggttaaccggggtttaccgtttttaacgttaccggtaggttaccggaacgggttaacggtaacggtaccggtttacctttaagttttaacggttacggtttttaaggtttttagggttaaccggttttacggtttttaacggtttaacccgttaaaccccgtacccgttaaacggttaaccgggtaccggggttacccgggggtacccgttaaccccccggggggtcccccggggtaaaccggtaaacgggtttaacccggttaacccggtttccgggttaacccccgttacccggggtttcccctttaccggtttaaacccccgggttaccctaacccccggttaaaccccgggg

SEQ ID NO: 143330 - DNA, 679 bp, Homo sapiens
  misc_feature: GYAE6OF02JMHFN.46.67.G01.1.454.CMB.1.raw
  modified_base (213)..(213): a, c, t, g, unknown or other
  misc_feature (213)..(213): n is a, c, g, or t
  modified_base (257)..(257): a, c, t, g, unknown or other
  misc_feature (257)..(257): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
tcagactagcagtacacgaccggtgctcgatttagagtatacatattgggtttggggggacctcctgtgcaagaacatgaagcacctgtggtttgtcctcctgctggtgggcagctcccagatgggtcctgtccctggtgcaactgcagggagtccgggcccacgactgggtgaggccttcgggacgaccctgtccctcacctgcgctgtctntggtcgcctcatcagttagttgtttctcgtggggctgggtccgnagctccgagggagggctggaatacattggaagtgtctctcatagtggacggttctattacngtctctctcaagngtcgacgtcaactatatcctcgtagactacgtcacgacacttctacgttttacccagtaacgtatacggtacgtttcgtacggtaccgacccggtcccgtcgtacggaccggtacggggttaccttttaacgtttcttgggtcgtaccggaaggtacgtaccggtatttcgttattagtttacggttttggtacgggtttaacgttttgtttacgtaacctcccgtaacggtacgtaccggggtaccggttccgtacccggtaccccgggtggggttaccgtagggtaacgttacggtcggttaccgtacccgttcggtttaccccgtaccggtacccttaacccggg

SEQ ID NO: 143331 - DNA, 703 bp, Homo sapiens
  misc_feature: GYAE6OF02JN5HC.46.67.G01.1.454.CMB.1.raw
  modified_base (199)..(199): a, c, t, g, unknown or other
  misc_feature (199)..(199): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggtccttcggacgaccctgtccctcacctgcgctgtctctggtcgcctcatcgagtagtggttctacgngggtctgggtccgcagtcctccgagggacgggctaggaatactagttggattcgtactcgtactagtagtcggtacggttccttaagtacgtacgttccgtacttctacgaagtagtccgtatccgaacctagtacgtctacgcggacctacgtcagtacatcgtacgtttccagactagtacgtgttctagtcgtaccgcgtactgaacgtacggtttcttaagtcgtacgngtacgtacgagtacggtacgtacgttagttacgttacgtttacgttaggttacggttcgttacgtttaccggtaccctaacgtacgtacgggtccgggacgggtccgtacccggacccggtaccgggtcggtaaacggttactccggttacgtaccgtccgttacgtcccgtacgtaccctaccggtaacccgaacgggttcctaccgtttacccggttccccgttacccggtcgacccccgttaaccgttcccgacccggtactacccgg

SEQ ID NO: 143332 - DNA, 721 bp, Homo sapiens
  misc_feature: GYAE6OF02F52P1.46.67.G01.1.454.CMB.1.raw
  modified_base (441)..(441): a, c, t, g, unknown or other
  misc_feature (441)..(441): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtggggtctggggtccggcagctacccgagggaacggggcttggaatacaagttggaagttgtctcgtcagtagtggaggttcctattacagtccgtctctacaagtagtcggatcgaccatactctcgtacggacacgttccagcaaatcctacgttttcccagaagatgtagttcctggtcgaccgcccgtcgttaggacgtacggggttatttaacgttactggtcgacgaggtagaccggtnttaagttactaggttagttttagggaagtttacggttagttttaccgaacgtacccgttaagacgttaccgggacgggggtccttaccggaccccggttaggggacctaaggggtaacttaccggtcggttacctaacccggttcgttacccgttacgtaccccgttcccgaacccggaaacggggtccccttaacggtaccccggtttcccgtttacccccggtcgggtaccccttacccccgttaccgttacccggaaacggtccccgttaaccccgg

SEQ ID NO: 143333 - DNA, 908 bp, Homo sapiens
  misc_feature: GYAE6OF02HRJ1T.46.67.G01.1.454.CMB.1.raw
  modified_base (706)..(706): a, c, t, g, unknown or other
  misc_feature (706)..(706): n is a, c, g, or t
  modified_base (748)..(748): a, c, t, g, unknown or other
  misc_feature (748)..(748): n is a, c, g, or t
tcagactagcagtacacgaccggtgctcgatttagagtatacatattgggtttgggggacctcctgtgcaagaacatgaagcacctgtggtttgtcctcctggctggtggcagctccagattgggtcctgtccctggtagctaactgccaggacgtcgggccctacggacgtgggtgagggtccttacgggacgtaccctcggtccctctacctgcggcttcggtctcctgggtactccctaccgtaagtccgtaaggttacggttggttttcctaggtcggggtcgttcgggggtaccggactacggtccgtacccgggaaggggggaacggggtctaacggtaaagtaccggttagttacgggtaaaggttccggtactaccgtaacggtaagttaccgggttagggttaacggttttacccttaagttttaacggaccgtttcccgtaacgttccggttaacgtaaaagggttcggttacgtaaacccgtccggtaaacccgtaacttttacggtacccgtttccgggtaaagggaacccctttaacccggttccaaaacggaactttaacggtttccgtttaaccccgttttaccgaaaggggtactacgttacgggtttaaacgtttcggtacggtacgggtaacccccgtactcggtacgaacgggttaacggtcggtttttaaactgtacgttaacggngtaacggaggtacgtcttaaagttgtacgttagtttacgggngtttaacggttacttaccggacctagtaaccggttacgttaccggggacgggttcccaccggttaaccgggcggggtttaaccaaggggttaaccttccgggttaccgttaacccgaccgtttacccggtttaaccggttaccgtaccccttaacccggg

SEQ ID NO: 143334 - DNA, 723 bp, Homo sapiens
  misc_feature: GYAE6OF02I6OK7.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtcctccatcctcctgtctgcaaccgtggagacngtcgacactatcacgttcggcccgggacaaggtccggaactacgtttcgaacctaaccttaagttttaaagttcggtactacaaactagtacgaccgacgggaccgtacccctaagcctacctaatctatcgctcgctactcgtagttgacgtaacggttccgggtaccctagtcggtaggttcgaggtcgacgaggtcggtagtcggtacgggaactagttactttccgacttacgtaccacgtactacgtaagttactacgtacgaactaacggtagtaagttacgtttacgacctttaacgtttacttaccgttacgtaacgtaactaaacttaacgtttaaacgttacgtttacgggtttaccgaaccggtaaacggtaccgtaaaccggtaaacttaaaaccttaaaacggttaaacgaacgtttagggtaccgtaccgtaacgacccgtacttaacgttccgttaacgttccgtttacctaccgtttcccgttacccgtaccttacgttaccgtattaacgg

SEQ ID NO: 143335 - DNA, 649 bp, Homo sapiens
  misc_feature: GYAE6OF02JD7TM.46.67.G01.1.454.CMB.1.raw
  modified_base (164)..(164): a, c, t, g, unknown or other
  misc_feature (164)..(164): n is a, c, g, or t
  modified_base (231)..(231): a, c, t, g, unknown or other
  misc_feature (231)..(231): n is a, c, g, or t
  modified_base (337)..(337): a, c, t, g, unknown or other
  misc_feature (337)..(337): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
  modified_base (595)..(595): a, c, t, g, unknown or other
  misc_feature (595)..(595): n is a, c, g, or t
  modified_base (602)..(602): a, c, t, g, unknown or other
  misc_feature (602)..(602): n is a, c, g, or t
tcagactagcagtacacgaccggtgctcgatttagagtatacatattgggtttggggagtctcggtcaggacacagcatggacatgagggtccccgctcagctccgtggggctcctgctactcgtggctccggaggtgccagatgtgacagtcgagctgacccngtctccatcctcctgtactgcaaccggtgggacacagtcgtaccaccatctacttgggaccgggtanaaacggttcggaaactcgttgaaccctaaccttaattttaaacgtcggtatacaactagtacgaccgtacgggacggtacccctaagccttacctaacgtctacgngtacgtgactacgtctaagttcgaaccgtaaggttcgggtaccagtcgtacggttanaggtcgcgtaaggntacgtcgaggactagtcttacacgtaccacaccgttgaactacgttaatcgtacgaacggtaaccgtaggtaaacttcgttacgtacgttaaacgttacttacgtagtaccgtaaagtacgttaattaccgtaagttcgttacggaacgtaacgtacgaactaactaaactaacgtaactacgttanacggtancgtacacgtctagtctaacgtctacgttcctctactctacgttaccg

SEQ ID NO: 143336 - DNA, 931 bp, Homo sapiens
  misc_feature: GYAE6OF02H5JYX.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatcgggtcctgtccctggtgcaactgcaggagtccgggcccacgactggtgaggtccttcggacgaccctgtccctcaccgtgcgctcgtcttcgtcggtcgtccctacctatccgaaggtttacggtttgggtttttccttacgggttcggggggtccgttcggggggtcccggcgaccggtcccggttaccccgggaagggggtaacgggggtccgttagggtaacgtacgttaacggtttaggggtaacggttcggttaccgttccgttaccgtaacggttaagggttacggggttaaccggtttttaacccgtttaacgtttaaccggttaaccgggtttcccgtttaccttaccgttaaccgtaaacggtaccggttaccggtaacggttaccctaaccctaacttaccgtttaccgtaccggttaaccggtacccgttaacccgtacccgtaacggtaacttaaccgttaccgtttaaccgtttttacccgtaaggtaaacgtagttacgggtttacgtttcggttcggtaccggtaccccggtaccgtcgtacgggtaccggtacgggtttacgttttacgtttacgtggttacggtacgacggtacggtacgttacgttaagtttacggttagttttaggttttacgggttaggttttacgtttaccggttaccgttaccgtaaccgttaacgtcggttaccgggtacgggtacccgtaccggtccgggtcgggtaccgggtaacggttaccgtacggttaccggtccttcccgttaccgttaccgttcctacccgtaacccgg

SEQ ID NO: 143337 - DNA, 964 bp, Homo sapiens
  misc_feature: GYAE6OF02HFOGA.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgacaacggtggganacagtcgtccacctatctacgtcggccggagaacgtacggaactagttcgaacctaacctttaaattttaaacgttacggttattaaccgtaaaacgtaacgttaaggaaacccggtaacgggggaccccggtacccccttaaaacggtccccgtttaaccccttaaaccgttaccttaaacgttcgtacccgttaacggtacccaacgtttaccccggttaggttttaaccggtaaaccgttaaacgggggtttaccggggttaaccccgttaacggttaccgggttaacggggtttacggtacgggttacgggttacggaacgggtttaccggggtaggttacccggttacggggtaaacgtaagggtttaacctttttaccaacgttccgtttaccctaaccgttactttaaaccgtaaacgtttaacgtaccgttaaaggaccggtttaaaaccgtaggtttaaaaccggtacggtttttaacaccgttttaaacgtttaacgtttaaccgtaaggtttaacctaaacgtttaacggtaaactttaagtttaaccggttttaccgggtttaaaccggtaccgggtaaaccgggtaaccgtaaacccggtttaaaccgttaaaaaccggtttaaaaaccttaaaaccggtaacgttacgggtttaacggtacctaacggttacccgtaaacgtaacctttaccgtttaaccgttaccttttaccgacgttaacccttccccggttaacttacttaccggtacttaaccg

SEQ ID NO: 143338 - DNA, 865 bp, Homo sapiens
  misc_feature: GYAE6OF02JMOE0.46.67.G01.1.454.CMB.1.raw
  modified_base (263)..(263): a, c, t, g, unknown or other
  misc_feature (263)..(263): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttgggagaccctgtccctcaccgtgcgctgtctcgtggtgcctccatcagtaggttgtttcttcgtggggctgggtccggcagtcctcccgaggggagggctaggaatacgtagttggattcgtctctanagtagtggtacggttctagtttacgacggttcccgttcttctacgtaacgtacggtcgtagttaccaaccgacttactcgttctacgggaacctaccgtccgacgaccaacttccggtacgttttacccgtagaaacgtgttacgtacgttcttagtccggtaacccgcggtactacgtaccgggtacgggtttacgttttacttacggttgttcggacggtaggtaacggtaccggttacgtttaagtttagttagttttacggttttgggttaacgggtttcggttttacgtttaccggtaccgttaaccccgtaacgttacggttaccgggggtaccgggtaccccgggtaccggttaccccccggggtacggggttaccccgggtaaggggttaaaccggtttaaccggttcgggttccccggtaacccgtttcccgttacccgtttacccgttacccccggttaccgtaaaccccgggtaaccccggtaacccggttaacccggtttccccggtttacccccgtttcccccggtacccggttccccccgtaaccccgttacccccggttacccgtaccgggtaacccgtacccccgg

SEQ ID NO: 143339 - DNA, 968 bp, Homo sapiens
  misc_feature: GYAE6OF02GA3EB.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctcgaggtcgccagatgtgacatcgagctcgacccagtcctaccactcctcctgtctgccaacggtggagtaccgaggttcgtaccacctagttccgtacgttcggacccggggactaaacggttaccggaaacttacgtttaacgaacccttaaccgttttaaagtttttaaaacgttcggaaacctttaccaaacggtacttaaccggaacccgtaacgggggtaaccccgtaccccttaacggtacccttaaccgtttaaactccgttaaacggtcgggtacccttacgggtaaccctaaccggttcccgttaaggggtttacggaaccggtttaaaaccgggggttcccggggttacccctaacgggtttaccgggtaacggtttcggtaacgggttccgggtaacccggttaaggggttccgtaaacgggtttaccggggttaacgggggtaaacctttaacggttaccgtttttaacccgaaccgtttacccgttaacccaaacccgtttcgtaacccgttaaggtttacctacggtacgaaccgtttaacggtaacggtttaagttacgtttacgaaaccgtttaactttaacgtaccgttagaacccttaaagggtaacctttaacgttaagttaccgtttttaccgggtaaccggtaaccgtaacggggtaaccttaaaccgtaaaccgttaaacgttaaaaccggtacgttaacgttaccggttacgttacctacggacccgtttaacttaacggtttaccttcggtttaccctaacgtttaaccccgttccgttaacccgttacttaaccgtttaccgggacttaacccgg

SEQ ID NO: 143340 - DNA, 608 bp, Homo sapiens
  misc_feature: GYAE6OF02JS264.46.67.G01.1.454.CMB.1.raw
  modified_base (98)..(98): a, c, t, g, unknown or other
  misc_feature (98)..(98): n is a, c, g, or t
  modified_base (123)..(123): a, c, t, g, unknown or other
  misc_feature (123)..(123): n is a, c, g, or t
  modified_base (162)..(162): a, c, t, g, unknown or other
  misc_feature (162)..(162): n is a, c, g, or t
  modified_base (202)..(202): a, c, t, g, unknown or other
  misc_feature (202)..(202): n is a, c, g, or t
  modified_base (326)..(326): a, c, t, g, unknown or other
  misc_feature (326)..(326): n is a, c, g, or t
  modified_base (416)..(416): a, c, t, g, unknown or other
  misc_feature (416)..(416): n is a, c, g, or t
  modified_base (447)..(447): a, c, t, g, unknown or other
  misc_feature (447)..(447): n is a, c, g, or t
  modified_base (493)..(493): a, c, t, g, unknown or other
  misc_feature (493)..(493): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
  modified_base (601)..(601): a, c, t, g, unknown or other
  misc_feature (601)..(601): n is a, c, g, or t
tcagactagcagtacacgaccggtgctcgatttagagtatacatattgggtttggggacgtctcggtcaggacacagcatggacgatgaggtccccgntcagctcctggggctcctgctactntggctcggaggtgccagatgtgaccatcgagctgaaccngtctaccatcccgtcctgtctagccgaacgtgggacacgngtcgaccactatccacgttggcccgggataaggtcggaaactgtttaccgactaaccttattttaaactggtacttacaacgacttacggacgacggacccggtccctaaggcccttacttaancgttaacgtgtctacgtctaactcgtagtttacgacgttaaaggtccgggtaccaagttcgtaacgttccgagttcgactgcgtatcggnggaactggtactccagtccctagacctaagngtacgattcgacgagtccgtaagtcttataccggattacctgtacngtacacgtatatcagtcgttacgagacgtacgtacataactacggnttacgagngttacacgacctggtactcggtttcaaccttcgttacctaccgactgtacccgngttaacc

SEQ ID NO: 143341 - DNA, 842 bp, Homo sapiens
  misc_feature: GYAE6OF02GPRWU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccagactggtgacggccttcggagccctgtccctcacctgcgctgtctcgtggtcgcctccagtcaggttgttggtttccttcggtcgggggcttacggggtccggcacgccttacccggaagggggtaacgggctagggaaactacgtaggttacgggaacttcggttacctcctacgtagttacgggtacgggtacggtttaccctaagttaccacggttcccgtacttccgtacgaaggtacgttcgacggttcccaaccgttattaccgtcgttaccgtcgggaacctaccggtccaagactaaccgttcgttacccggttttaccctaaggaacgttacgtttggacggttttctacgggtacccgacccggttccgtacgtaccgggtaacccgttacggggtttaaccttttacggtacgttcgggtaaccgtacggaaggtacgggtaaccctttagtttacgtttaagtttacggttttaggttttacgggtagggttttgtttaaccgttaccgaaccgttaccgttgtaccgggtaccgggccgggtccctaccgggaccccggttaggggaccgtacggtaacgttaccggcggttacccttacccgtcgttaccgtacgtcccgtaaccgaccggtaaccgtcccgtccgttacccggtcccctttacccggccgtacccctacccggtccctaacggtaccgtctacccgg

SEQ ID NO: 143342 - DNA, 725 bp, Homo sapiens
  misc_feature: GYAE6OF02HAPQY.46.67.G01.1.454.CMB.1.raw
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcaccgtgcgctgtctctggtgcctcatcaggttagtcggtttcttcgtgggtcgtgggtccggcagcctccgaggggaaggctaggaatacagttggaacgtgtctctcagttaggtggtacggttcttagttacgacgttccgtctctacgtaagaggtcgagtcacctagttntccgtcnggactaccgtcgacgctaactccgtacgtttaccctaggaacgtgtagtaccgtttgtcggtaccggacccgtcccggtcgtaacggacggtaccgggtttacgttttaacgttacgtacggtcggtacggtacgggacgtacgggttaactttagtttagttacggtttagttttacgggtaaggtttcggtttaaccgtttacgaacccgttaccgttaaggtaccggtccggggtaccggggtacttccccgggtaccgggtacggggtaaccggtagggtaacttacggtcgtaccgtccgttaccgttcctaccgcccgtaccgtacggccggtaccctgttcccgtcccgtcccgtccgtccctacccgtcaccgacgtccgtaccg

SEQ ID NO: 143343 - DNA, 703 bp, Homo sapiens
  misc_feature: GYAE6OF02GSTVL.46.67.G01.1.454.CMB.1.raw
  modified_base (94)..(94): a, c, t, g, unknown or other
  misc_feature (94)..(94): n is a, c, g, or t
  modified_base (484)..(484): a, c, t, g, unknown or other
  misc_feature (484)..(484): n is a, c, g, or t
  modified_base (648)..(648): a, c, t, g, unknown or other
  misc_feature (648)..(648): n is a, c, g, or t
tcagactagcagtacacgaccggtgctcgatttagagtatacatattggggttgggagtctcggtcaggacacagcatggacatgaggtcccgntcagctcctgggctcctgctactctgactccgagtgccagatgtgacatcgagtctggacccagtctccagtcctcctagtctgacaaccggtggagacgtagtcgtacaccgtatcacgttcgccgggactaacgtcggaaccattcgaacctaaccgttaattttaaagttcggtaattaccaaactacgttaacggaaccgtaaggggtacccgtaccccgtaaggtccttaaccgttaattaccgttagtacgaccgttacgacgtacgttaccgtaaggttttacgaacggtaaacggtccggggttaaccctagtacggttacggtaccgtaaggtcggtacgtacggtacggagttccgttaagggaactagttaccgtttanaaccgttctaccgacgtactagaacgtactaccgtagtaccctaagtaacgagtttactttacggacttaacgttattacgtactacaacgattaaacgtattaacgttacggttacgaaccggtacggaacttaaccgaataacgtaaacttaccgaagtcgngtactcgacgccttaagcttagtactccgacttaccggtcagttctcgtagtacc

SEQ ID NO: 143344 - DNA, 754 bp, Homo sapiens
  misc_feature: GYAE6OF02I6SWJ.46.67.G01.1.454.CMB.1.raw
  modified_base (486)..(486): a, c, t, g, unknown or other
  misc_feature (486)..(486): n is a, c, g, or t
  modified_base (588)..(588): a, c, t, g, unknown or other
  misc_feature (588)..(588): n is a, c, g, or t
tcagactagcagtacacgaccggtgctcgatttagagtatacatattgggtttggggagtctcggtcaggacacagcatggacatgacggtcccgctcagctcctggggctcctgctactctggctccgaggtgccagatgtgacatccgagctacgacccagttcctaccactccctcccgtgttcctacggaccgtaaccgggttcgggaacgtacgtaggtaccgtccaaccctacttaccgtacgttccgggaacccggacgtacggtaccgaaacgtacgttacgaaccctaaccgttttaatttaaacggttcggttaaccttcgaaaacctagttaaccggaccgggtaaccgggtacccggtaccctaaagtcccttaactaacgttaccgtacgtcgtaccgcgtactacgtttccgtaggtacgtaacggtaacgggttccggacctagttgaccggtctaggtaccgtcgtaggntaacgtcggtacggattacgtcttaccaccatcccactaagtcgtaagttacgtactacggaacttaggacttaaggttactacgtacttacgttactgtanacgaacttaagtacgtacttacggttcgttacgaacggtacgaaccgtactaaacgtaaacttaagttaaaccggtgttacgtaccgtattacccgagtaaccgtacttacggtctacccttaaggtcccttaccggtaccctacttcggtacttaccgttaacgg

SEQ ID NO: 143345 - DNA, 625 bp, Homo sapiens
  misc_feature: GYAE6OF02F9OX3.46.67.G01.1.454.CMB.1.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (562)..(562): a, c, t, g, unknown or other
  misc_feature (562)..(562): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagagtgtgacatcgagctgacccagtcctcctatccctcctgtctgcaaccgtgggagacagtgtccaccatctacgttcgccggganaggtacgaactnttacgactaccttaatttaagtgtatcaactagtacgacgagggaccgtccctaagtctacctaatctatgtctgacagtaccgtagttcgaacgtaacgggtccgggtaccaagttcggtacgtctaggtggactaggtcgtagtcggtacggactagtacttctaccgtctaccgactagtactaatactcgtagtacgtaagtacgtattagttacgtacttaattctaagttctaacgtaactaataattactaacgtttcgttacgaacggtaagtacctagtaaaccttaaataaacgttacgtacagtacgggtacncggtacctctacgttacgttcgtaacgttctaccggttccaccgtattacctagtattaaccg

SEQ ID NO: 143346 - DNA, 154 bp, Homo sapiens
  misc_feature: GYAE6OF02JGFRE.46.67.G01.1.454.CMB.1.raw
  modified_base (126)..(154): a, c, t, g, unknown or other
  misc_feature (126)..(154): n is a, c, g, or t
tcagactagcagtacacgaccggtgctcgatttagagtatacatattgggtttgtcctcctgctggtggcagctcccagatgggtcctgtccctggtgcaactgcagggagtcgggcccagacgtnnnnnnnnnnnnnnnnnnnnnnnnnnnnn

SEQ ID NO: 143347 - DNA, 876 bp, Homo sapiens
  misc_feature: GYAE6OF02FH87M.46.67.G01.1.454.CMB.1.raw
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggcccttcggagaccctgtccctcacctgcgctgtctcgtggtcncctccatcagtagtggttcttcgtgggctgggtccgnagcctccgaggggagggctggaatacagtggaatcgtctactcagtagtggacgttccattacgagtccgtctcctgaagagtcgagtacaccagtactcgtcgtcggactaccgtcacgtcgaactcgtacgtttttccccgagaacgtagtagtacgttgtcgtacggacccggccccgtcgtcggtaaccggtccggggttacgtttttaacgttaccgttggttagggaccgtaacgggaacgggtacccgggtactttaagtttaacgttggtttaaaggttttttacggggtaacgggttttagggttaaaccggtttttccggtaaaccccgtaaccccgtttaaggtaccgggttacccggggtacccggggggtacccttacccccgggtaaccccgggttaccggggggtacccggtaaacggggtaacggtttaaccccggttcggggttaaccccgtacccggttacccggtttaacccgtttaccccggttacccgtacccccggtaaaccccgggaaaccccggggtaccccttaacccgggtttacccccggtttacccccgttttcccccccggttacccgggtcccccgttaacccccccgttaaccccccgtacccggttaaacccggtacccggttaacccccccgg

SEQ ID NO: 143348 - DNA, 729 bp, Homo sapiens
  misc_feature: GYAE6OF02GJ8IV.46.67.G01.1.454.CMB.1.raw
  modified_base (714)..(714): a, c, t, g, unknown or other
  misc_feature (714)..(714): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaacggtggagacagtgtcaccatcacttgccggcaaggtcggaactattgactacctatttaaattgtatcaacatacgaccgacgggacgccctaagctacctaactctatgtctgctactcctagtttcgacgtaaacggtcgggtacccagtacgtacgggttacaggtcggtacgtagttacggagttacggtacgggtaacgtagttaagtttacctaccttcgtaccctaacctacgtttaaccgtaacgttaacttaccgttacggaacgtaaacggtttaacggtaaagtttagttttaacgtaaccttaaaccgttttagtttaaccgttaacgtaacctaaacgtaacgttaaactttaacttaacgttttacgggtttaccggtaaccggtaaacgggtaacctaaccgtaaacgtaaacttaaaacgttaaacgtaacgtacggtaggtaccgttacgacccgtaaccgtactttaccttcgttacctttacgtacctttacccgttcccgtaacccgtnttaccgtagttaccg

SEQ ID NO: 143349 - DNA, 727 bp, Homo sapiens
  misc_feature: GYAE6OF02IT8SA.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggccacgactggtgacggccttcggagaccctgtccctcacctgccgctgtctcgtggtcgcctccatccgagttaggtgtttcttcgtggggctcgggtccgcacgcctcccgaggggaacgggctaggaatacgtagttggaagtgtactctcattaggtggtacggttcctagttacncgtccgtctctacaagtgtacgagtcactatactctacgtgacctacgtcagactaactaccgttacgttttcccaaggaacgtatgtaacgtttcgtacggtacgacccggcccgtacgtacggaaccgtacggggttacttttaaacgttaccgttaggtacgaccggtaaggtaaccgtacgggtatttaagttacgttagtttaacggttttttagggacgtttaggttttcttaacccggaaccttaacccgttaaggaccgggttaccgggtaccggggtacccttacccgggtcccgggttaccggggaacgtaacgggttaacgttaccggtccggttaacccgtcccgtttacccggttaccgttaccgaccccgttaacccgg

SEQ ID NO: 143350 - DNA, 807 bp, Homo sapiens
  misc_feature: GYAE6OF02GJ8KA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctcgacaaccggtgggagactagtgtaccaccatcgtacttggcccgggcaacggtcggaactagttcgaactacccttaatttaaagttggtaacttaccgaaactaagtaacgaaccgaaggggacccggtacccccgtaaagccgttaaccttaaacttacgtaacttggaccttaggcctaacgttaccccgtaggttttacgaacgtaaaacgggttcggggtacccctaaggttaccggtaggttacgacggttcggacgtaggttggaattcggtaagggaacgtaacgtactttacctacgtaccttaccgacctaacttacgtaaacggtttactccttacggaactaaacggtagtaaagttcggtttaacgtaaccttaaaccgttttacttaccgttaacggtaaaccaacgttaaagtaaacctttagtaacggttttaccggtttaccgggaaccggttaaacgggtaacctaacggtaaaccgttaaacctaaaacggttaaccgtaaacgttacggtaacggtaccttaacggacccgtacttaaccgttccttagtttaccttaacgttacccgttcccttacccgaccttaccgttcctaaggttaaccc

SEQ ID NO: 143351 - DNA, 829 bp, Homo sapiens
  misc_feature: GYAE6OF02HP35E.46.67.G01.1.454.CMB.1.raw
  modified_base (178)..(178): a, c, t, g, unknown or other
  misc_feature (178)..(178): n is a, c, g, or t
tcagactagcagtacacgaccggtgctcgatttagagtatacatattgggtttgtcctcctgctggtggcagctcccagatgggtcctgtccctggtgacaactgcaggagtccgggcccagactggtgacgccttcggagaccctgtccctcaccgtgcgtctgtcctcgtgggtcnccctacatcgtaaggttgttggtttcttcggtggggcttcggggtccggactacggcccgttaccgggaaggggtagggtctaggaaactcgtaaggttggaagttcgtctcacgtagtagtacggtacgttcctaattaccgacgttccgtctactacgagtcgtacgacgtaccactagtctcgtcgaggacctcgtacacgtactaacgtcgttactttaccgagtaatacgtacgttagttcgttaacggtccgaccgtacccgtgaccgtaccggttaccgggtttacgtttaacgtccggtggtacggtaccggtaagtaccgggcgtttaacgttagtttagttacggttttagttttaaggggttcgtttaacggtttaaccttaccggtaaaccctaacggtacgggttaaccggtaccgggggtaccgggtacccgttacccgggtaccggggttacgggtaaccggaaacgggttacgttaacggttacccggttacccgtaccggttacctttacccgttacccgtaccccgtacccgttaaacgggccccttccggttaacccggttccgtttaccccctcccggtacccgtaccccggttacccctacccgttaacgtaccggtacccgtaacccgg

SEQ ID NO: 143352 - DNA, 854 bp, Homo sapiens
  misc_feature: GYAE6OF02H4AGQ.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccagtctccatcctccctgtctgcgaacgtgganacagtcgcacatcattcggccggacaagtaccggaacattgaacctaacgttaattttaaattggttacactaaacgtaagtaacgtaaccggacggggtaacccgtaccccgtaaagaccgttacccttaaagtaccgttacgtacgtaccttacggactacgttaccgttagtttacgaacggtaaaccgggttccggggtacccaacgtttcggtacgtttaggacggtggaaccttaggttacggtagttacggtagggtaacgtacggtttaacgtttaccgaccgtttacctaccgtaaccgtacttaacggttaacgtttaacgttcgttaacgtaccggttaaacggtacgtttaagttaacgttttacggaaacctttaaccgtttaagttaccttacgttaaaccgtaaaacgtaagtttaaacgtaacgtttaaatttacggtttaccgggtaaccgtaaacgggtaaaccctaaacgttaaacgttaaaaccttaaaacgggtaaaccctaaaggggtttacctaccggggttactaccccggtaacgtaacgttacccgtttacgtacccgtttaacccgtttcccgtttaacgtttaccccccttacccggtttaaccctaacggtttacccttacggtttaaaccccgg

SEQ ID NO: 143353 - DNA, 793 bp, Homo sapiens
  misc_feature: GYAE6OF02FLGOO.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggtcctcctgctggtggcagctcccagatgggtcctgtccctggtcgcaactgcaggagttcggcccacgactggtgaggccttcgggagaccctggtccctgacctgcgctgtctctggtcgcctccatcgagtagttgttctcgtaggggcttcgggccgnacgcctccgaggggtacggctaggaactctagttggaacgtgttcctcgtcaagttacggtaggtacgttcctagttaacgacggttcccttcgtactcgaaacggtgtccgattaccaaccgtattactccgtacgtaggaccaccgtcacgactaattccgttaacgtttccagaagtcttggacgttgtcggtaccgccgtcgtactacggtaaccggtccgggtttattttacttaccggtagtcgggacgtacggtacggtaccggtcgttaaagtttcgttaaggtttaggtttttacggtaagggttttacggtttaacgtttacccggtacgtacccggttaggtacggttccggggtaccgggttacccgttacccgggtacccgggttccggggaacgtaacgggttaaccgttacggttcggtaacccgtaccggttaccgttcccgttacggtacccgtaaccgaacgggtaacccggtccgtaacggttcccggttaccccgtttaccccggtccgttaccccgtaccccgttaccgtacccggtaccgtacccgtaaccccgg

SEQ ID NO: 143354 - DNA, 675 bp, Homo sapiens
  misc_feature: GYAE6OF02HDKVU.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtccacatcacttgccggacagtcgaatattgactacctattaattgtatacaactatacgaccagggaccggtacccctaagcctacctaatcctagtcgctcgacactcctagtttacgaccgtaaagggtcggggtaccctagtccggtacggttccgagtacggcgtaggtcggacttcgtagggaacctagtactttaccgaccgttactaccacccgtatacgtaacgttaactcgtacgacctaacggtagtaacgttgttttacgacttaacttacttacgtacgtacaacgttaataactttaccatttacggtttccggaaccggtacggtaccacgtaacttaaacctaaacgttaaaccggaatttcggaggttcctaacgtaccgaaccgttacgttccgttacggtttacccgttacctaccgtttacccgttaccccgaccttacgtcccggttattaacccgg

SEQ ID NO: 143355 - DNA, 639 bp, Homo sapiens
  misc_feature: GYAE6OF02FMZ6V.46.67.G01.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (318)..(318): a, c, t, g, unknown or other
  misc_feature (318)..(318): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgaccaaccggtggganacngtgtcaccatcacgttgccggacaacggtacggaanattcgactaccttaatttaagttggtatcaacataagaccagggtaccgtacccctaagcctacctaatccgtatcgacgtancgaccgtacgtagtttacgaacgtaaagggtccggggtaccctagttaccggtagggtttaccaggtacggtacgtaggttagggtaatcggtagggtaacctaggtactttcgactcgtaccaactctacgtacgtactcgtacgagtaacgtagtaacttgtttacgaaccttaatattaccgttgtaacaacgtaatacttacgtacgttcggttacgacgtacggacacgtaactaacaaagtaacacgtgtacgcgtacaccgtcgtaattcgtacgttacttacgacttccgtcccattacttaccgagttaccg

SEQ ID NO: 143356 - DNA, 676 bp, Homo sapiens
  misc_feature: GYAE6OF02F5IBV.46.67.G01.1.454.CMB.1.raw
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
tcagactagcagtacacgaccggtgctcgatttagagtatacatattgggtttgtcctcctgctggtggcagctcccagatgggtccctgtccctggtgcaactgcagggagtcgggccccacgactggtgacggcctttcggagacccctgtcccctcacctgcgctgtctctggtgcctccatcagtagtgtttcttctgggctgggtccggcagcctccaggggaagggctggaatacagttggaagtgtctcncatagtggagttcctatacagtccgtctctcaagngtcgagtcaccatactcgttcacgacaccgtaccagactaatactacgttttccctagaacgtatgtaacgttctgtaccgaacccggtccgtacgtacgacggtaaccgggttacgtttaacgttacgttgtacggcggaagacggacgtacttattaagttagttaacgttttagggtagttaggttactttaccggaacctacccgttaagacgtacgggaccgggtcgtaccggacccgtcgggaccgtagggtaacgtacgtacggtaccgtaccgtcgttacctagtccctaccgaccgtaaccggaccctacgttcccgttacccgttaccccgtccggtacccgtaccccgtaccgtacccgtaacgacgtacccg

SEQ ID NO: 143357 - DNA, 821 bp, Homo sapiens
  misc_feature: GYAE6OF02GXHTN.46.67.G01.1.454.CMB.1.raw
tcagactagcagtacacgaccggtgctcgatttagagtatacatattgggtttgggggagtctcggtcaggacacagcatggacatgagggtccccgctcagcctccgtggggctcctgctactctggctcgaggtgccagatggtgacatcgagctgaccagtctccactcctcctgtcgtcgcgaaccgggtgggacgacgaggtcgtaccaccgtatccgtacgttcgggacccgggtactaacgggtaccgggtaactacggtttaccggaacctaaccctttaaaggtttttaaaacgtttacgggttactaaccgtaaacgtaacgttaaccggacccgggaacgggggtacccggtacccccgttaacgttacccgttacccttaaacgttccgttagtcgtcgttacgaccgttaaccgttcgttaagtttacggaacggtaaacgggttccgggtacctaacggttacggtacggtacggtaggtcggtacggtaggttggtacgtacgggtacggtaactacggtactttacgaccttaccgtaccacgtaaccttacgtaacgtacgtacggtactacgtaacggtaacgtaacgtttcgttaacgtaactttaaccgtttaattacgttacgaacttaaacgtaataaacgttaacttacggtttacggttaccggaacggtaacgtaaccgtaacgtaaccttaaagttaaacgtaacgtaaggtacgtcgactccgtactaccgttacttacgtacgtttacctcgttaaccgttccttacccgtacttacgtcgttacctaacggg

SEQ ID NO: 143358 - DNA, 776 bp, Homo sapiens
  misc_feature: GYAE6OF02FQ17G.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctcctgtctgcaaccggtggganacagtgtccacctagtcctacgttcggcccgggactaacggtaccggaaactagtttacggaaccttaaccctttaagtttttaaacgttgggttaactaccaaactagtaacggacccggaacggggtacccgaccccctaaaggccttaaccttaacttacctagtacgccgtacgcctacttcccggtaagtttccggaacgtaaacgggttcgggtaccctacggtcggttacggtttaccaggtccggagtagggttaggtacttcgggtaggaactaggtactttaccgtacctacttaccgacctactacgtaagttactctacggacttaagtacggttaagttacgttttaccgaactttaacgttacttaacgttacgtaaccgttaaataaggttaaaccttacgttaacggtttttcggttaacccgggaccgtaaacggggtaacctaccggtaaacttaaacgtaaaacggttaaacctacgggtacgttacgtaccgtcgaacccgtacgtactttcgtccgttacttaccgtctttacccggttacgaccttattccgtataccgg

SEQ ID NO: 143359 - DNA, 730 bp, Homo sapiens
  misc_feature: GYAE6OF02HI0EH.46.67.G01.1.454.CMB.1.raw
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (576)..(576): a, c, t, g, unknown or other
  misc_feature (576)..(576): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgaccgtaaccggtgggacacgtaggtcgtaccacctactctacgttcggccgggacgtaacggtacgggaaacctagttacgaacccttaacctttaagttttaaacgttgggttaactaccaaaactaacgtaacggaacccggaacggggaaccccggtaacccccttaagaccctttaccgttaaacttaccgttagtcgccgtacgtactacgttaccgtaggtttcggaacggtaacggggttccggggtacccctagttcgggtaggtttacgagggttcggaccgtagtgggtactcggtacggacgtagtactttccacttcncactntcgttagacttcncgtaacgtaacgtgtaattcgttacgtacttactttaacgtcgttanaacctaactaattaactacttaagtttcgttacggaacgtaacggactaccgttaactaaaactaaacgtaacgaccttggacgtcgtacaccgtactacttacgttccgtacttaccttcgttaccccgtccttacccgtctaggtactaccg

SEQ ID NO: 143360 - DNA, 837 bp, Homo sapiens
  misc_feature: GYAE6OF02I7DS7.46.67.G01.1.454.CMB.1.raw
  modified_base (207)..(207): a, c, t, g, unknown or other
  misc_feature (207)..(207): n is a, c, g, or t
  modified_base (263)..(263): a, c, t, g, unknown or other
  misc_feature (263)..(263): n is a, c, g, or t
  modified_base (364)..(364): a, c, t, g, unknown or other
  misc_feature (364)..(364): n is a, c, g, or t
  modified_base (442)..(442): a, c, t, g, unknown or other
  misc_feature (442)..(442): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggaggtccgggcccacgactgggtcgacggtccctttacggacgccccttcgtacccctnacctggccgctgtctccgttggtcgccctccatcgtagtcgttcggtttcttcggnggggtccgttcggggacccggcacgtccctacccgggaaggggtacggggtactaggtaactacgtggttacgggaattcgtacctcctacgtattacggnggtaacgtttcctataccgtagttcccgtatcgaacgaaggtcgacgtacgttccctaacctagtcgtacttaccggngtaacccaccgttccgaataccgtaacttccgttttaacccgtttccaaggagtagtttcggtatttacgtccgtaccggacccgtccggactaccggtaaccggttacggggtttcctttaaccggttggtccggtaagggtcgtaacgggacgttaccggttataaccgttttaggtagttttacgggtttttaagggttagggtttaacctttttacgtaaccccggttacccgtaaacggttttacggtaccggttacccgggggacccgggtttccgtaccccgggggtaaacccccggttgggggaacctttaaaccggggtactttaacggggtaccctttacggacccggtttaattccccgttaacccgtttacccggaacccccg

SEQ ID NO: 143361 - DNA, 772 bp, Homo sapiens
  misc_feature: GYAE6OF02JHE2N.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggcgtcgggcccacgactgggtgaggtccttggacgtaccctcgtccctcacctgcgtctcgtctgtggtcgcctcatcagtagttggttctcgtggggctcgggtccgcgacgtcctcccggaaggggaacggggtctacggaaattacgtacgttagggtaagttcggttctctacgtaggttacggtgggtaacgttccttagtacgtacggttcccgtatccgtaacgaacggtggtacgtaggtaacccactaattacgtccgttacgtcggtaacctaccggtaccaagtacctaacgttccttaacgttttcccgaaagtaacgtagtacgttacggttcgttcggacccggtacccgtccggttactacgggtaccggtaccgggtttctttaacggttccgtagtccgaacggtaacggtcgaacggttctttagttagtacgttttagggtttaggtacgttgggttttaccgtaccgtaaccggtaccttaggaccggtttacggggtacccgggttcgtccccgggtaaccgggtcggaacccggtagggtaaacttccggttaccggtccggttacccgtttacccggttacccttaccggccccgttaaccgg

SEQ ID NO: 143362 - DNA, 640 bp, Homo sapiens
  misc_feature: GYAE6OF02JR99O.46.67.G01.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
  modified_base (484)..(484): a, c, t, g, unknown or other
  misc_feature (484)..(484): n is a, c, g, or t
  modified_base (616)..(616): a, c, t, g, unknown or other
  misc_feature (616)..(616): n is a, c, g, or t
tcagactagcagtacacgaccggtgctcgatttagagtatacatattgggtttggggagtctcggtcaggacacagcatggacatgagggtccccgctcagctccgtggggctcctgctactcgtggctcggaggtgaccagatgtgacatcgacgctacgaccctagtcctccattccctcccgtgtctcgacaaccggtgggacacngtgtccacgtntcgattcgccgganaaggtcgaacatcgactacctattttaacgtggtatacaactacgtaagaccgacgggaccgacccctagaccttctaatctatgactcgntacgtctgttanacgtaacgtggtcccagttacgaggttcaggtggacngtgatccgnggtntacgtatcgatctacgaacctnacgttaacgtatcgacgtaaccgaaggttctaagttatttacacgttacttagttcgacataaactctaattacncgtttagtccgggttaaaacggaccttaaactaaacgtaaaccgttaaacgttaaaggacgttttaccggaaggacccaagggtttcccaaaagtttcgttcttaacccgttcgtttaacaccggtttcccncgttccaacggtttctagtacccg

SEQ ID NO: 143363 - DNA, 752 bp, Homo sapiens
  misc_feature: GYAE6OF02FZV6T.46.67.G01.1.454.CMB.1.raw
  modified_base (187)..(187): a, c, t, g, unknown or other
  misc_feature (187)..(187): n is a, c, g, or t
  modified_base (484)..(484): a, c, t, g, unknown or other
  misc_feature (484)..(484): n is a, c, g, or t
  modified_base (674)..(674): a, c, t, g, unknown or other
  misc_feature (674)..(674): n is a, c, g, or t
tcagactagcagtacacgaccggtgctcgatttagagtatacatattgggtttggggagtctcggtcaggacacagcatggacatgagggtcccgctcagctccgtggggctcctgctctctggctccgaggtgccagatgtgacatcgagctgacccagtctcatcctcctgtctgcaacgtgganacagtgtcaccatctacttcgcgggacaggtaccggaactagttacgacctaccttaattttaaacgtggttactacaaactgtaacgaccgagggaccgtcccctaagccttaccgtaattacctagttcgaccttgactactaccttacggtttacggacgtaaacgggttcgggttaccccaagttaccgggtaaggttcgtaacggtcggtacgtacggttacggagttaccggttacgggactacgttaacgttactaccttccgtaccgtaactaacacgtaacggttaanccgtttacgacgtaaacgttacggtaaacggttatttaccggaattaacgttaacgttacttaacggtacctaaagggaaacttaacgttaaccgtagtttaacggggttaaccaccggtaagggtaaacctcccggttaaataaaccggtaaaactttaaaccggaacgtttcgggtaaggtcctaaancccggtaaaaccttgttaccccgtaagtttcccgtaaacttcgtacccgtttaccgaacgcccgtttaagcgttaacc

SEQ ID NO: 143364 - DNA, 596 bp, Homo sapiens
  misc_feature: GYAE6OF02GKCAV.46.67.G01.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (470)..(470): a, c, t, g, unknown or other
  misc_feature (470)..(470): n is a, c, g, or t
  modified_base (489)..(489): a, c, t, g, unknown or other
  misc_feature (489)..(489): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcnctgtctctggtncctcatcagtgtgtttctcgtggggctgggtccgnacgctccgagggagggctggaatacattggaagtgtactctcgtataggtaggtacggttcctagttacacgtccgttctctcaagtagtaccgagtccacatactctcgtacgactaccgtcagacaacttcctaacgttttcccgagaagtactagtacgttctagtaccgacccgccgcttagaccgtacggtactttatacgtgtacgcgagacgacgtntaattagtagttagtttgngttgtttacttcgaacctaccgtagtactcgggcgggtcctccggtcccggtgggacctaggtaacttcgtcggtaccgtaccgttccgttacctaccgcctacccg

SEQ ID NO: 143365 - DNA, 743 bp, Homo sapiens
  misc_feature: GYAE6OF02GZTVG.46.67.G01.1.454.CMB.1.raw
  modified_base (117)..(117): a, c, t, g, unknown or other
  misc_feature (117)..(117): n is a, c, g, or t
  modified_base (222)..(222): a, c, t, g, unknown or other
  misc_feature (222)..(222): n is a, c, g, or t
tcagactagcagtacacgaccggtgctcgatttagagtatacatagttgggtttgggggacctcctgtgcaagaacatgaagcacctgtggttgtcctcctgctggtggcagctccngatgggtcctgtccctggtgacaacgtcgcgacggacggtccgggcccacgtacgtggtgacggtccgttacggacgtaccctggtccctaccgacctggccgtntcgtctcgtcggtacgcctacatacgtagttaggttgtttcgtcgtggggacctcgggtccgagtacgtcctacccggaggggtaacggggtctaccgggaataaccgtagttacgggtaacggttctccgtactacgtagttaaggttcggttaccggtttaccttaagttaccgacggtttaccttcaaccgtgtaagtacggtacgtacgtacctaaccgacgttactcgtacgtacgacgtacctaccggaactacgtaacttcgttaccgttttaacccgaggtaacgttacggtacgtttacgtcgtaacgtcgaacccggtcgagtcggaaccggttggttaccgtttagttacgtcgtacggtacgtaacggagtcgttaccttagttgttagttacgtttaggtcggtttagttctaccggttactacgagtcgcgggtaccgggtctccggaaccggtcggccggtaacgtacgttcgtcgcccgtacgtcctacgtcggccctacccggg

SEQ ID NO: 143366 - DNA, 800 bp, Homo sapiens
  misc_feature: GYAE6OF02GULM7.46.67.G01.1.454.CMB.1.raw
tcagactagcagtacacgaccggtgctcgatttagagtatacatattgggtttgggggaccctcctgtgcaagaacatgaagcacctgtggtttgtcctcctgctggtggcagcctcccagatgggtcctgtccctggtgccaactgcaggacgtccgggccccacgactggtgacggccttcggacgtacccctcggtcccctcacctgccgcttgtctctcggtcgccctcctatcgagttagttcggttttcttcgtggggccgttcggggtcccggcacgcctaccccggaggggaacggggtcctaggaataactagttaggaacgtcgtcgtctacgagttaggtggtacggttcctattacgtacggtccttctacgtacgaagtacgtcgtacgtccaccaattacttccgtcgtacggaacctaccgtactacgacctaacgttccttaaccgttttcccgaggtaacgtagttaggtagtttccgtcggtacccggcccgtcccgtacgtaccggaccggtttaccgggttacgtttttaacgtccggtcgttacggaacggtaacgggtacgggaccgttactttacggtttacgttgttttagggtttttacggtagggtttcggttttaacgtttccgaacccgtttacccgttaaggacccggttaccggggtaccggggttccccgtaacccgggtccccgggtacgggtaacccggtaagggttaccttacggtaccggtcccgttacccggttacccgtacccttaccggccccgtaaccccg

SEQ ID NO: 143367 - DNA, 735 bp, Homo sapiens
  misc_feature: GYAE6OF02H9AMH.46.67.G01.1.454.CMB.1.raw
  modified_base (678)..(678): a, c, t, g, unknown or other
  misc_feature (678)..(678): n is a, c, g, or t
  modified_base (702)..(702): a, c, t, g, unknown or other
  misc_feature (702)..(702): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggacacagtcgtcaaccgtatactacgttcggcccgggataaacggtaccggaaacctagttcggaaccctaaccgtttaaagtttttaaaacgtttggtaacttaaccgaaaacgtaacgttaacggaaaccgaacggggtaaccccggaccccttaaacggacccttaccttaaaacgtccttaagtcgtacgttacgactacttaccgtagttttacgacgtaaacgggtcgggtacccaagttcgtaggttacaggtcggacgagttagacgtacgtagggtaactacgtatttccaacgttccactacgtactacgacttaactccgtagacctaagtagtaaacttcgtttagaacttaaccttttagtaccttaggaacctaaacgtaattaacgtttaacctaggtttaccgtttaaccggaaccgtaaacgggtacccaaaccggtaacttaaacgttaaaacgtaaacgtaacgttacnccggtactacgtacgactacggtntccgttactgtactcctccgtacattcgataac

SEQ ID NO: 143368 - DNA, 741 bp, Homo sapiens
  misc_feature: GYAE6OF02GIDVZ.46.67.G01.1.454.CMB.1.raw
  modified_base (448)..(448): a, c, t, g, unknown or other
  misc_feature (448)..(448): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactccctcctgtctgccaaccggtgggacgacagtgtccaccatcgacttcggccggactaacggtacggaactagttacgacctaaccttaatttaaagttaggtactacaaacagttaacgaccgaaggggtacccggacccctaagccttacctaatctatcgtctagctactcctagtttgacgtaaggtcggtcccagtcgtagttcaggtggctaggtgtcgtacgtgggaactagttacttaccgactccgtaccaccgtatacctaagttaacncgttacgtacgtaacggttagtaaattacgtttacgaacttacgttttaacttacgttactacgtaaacgtaagttaaacttacgtttaacgtttacggtttaccggaaaccggaacggtaacctaacgttaaaccgttaaaccgtaaaaccgttaaacggtaaacgttccggtaacggttaccgtaggaacccgttaacccgttacgttacgttaccgtttaacccttttacgggttacccttacccccgtttaccccgaccggtttaaccttaccggttttacgtacccgg

SEQ ID NO: 143369 - DNA, 599 bp, Homo sapiens
  misc_feature: GYAE6OF02FMSW6.46.67.G01.1.454.CMB.1.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaaccgtggagacagtgtcaccatcacttgccgggacaagtcggaacattgacaaccttatttaaattggtaatcaacatagaccagggaccggcccctaagctcctaatctatgctncatccagtttncaaaggtgggtcccagtcgtaggttcagtggcagtgatcgtagggacagactttcacttctacgaccagtcaagtaatctgacctaagtgaagtattttcgacttaaactttaattaacttacgtacaaactaacgtaaattaactaaaggtttcgttttaacggaccggtaaacgggtaccaaaccgtaactaaaccgtaaaattaaacgtaaacttacggtgacgtcgacctaaccattaccgttggttaccttccgattcccttacccgccctaatctagtaacc

SEQ ID NO: 143370 - DNA, 753 bp, Homo sapiens
  misc_feature: GYAE6OF02JGIR9.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctggacccagtctccactccctcctgtctgccaaccggtgggaagacagtgtccacctatcgacgttcggccgggactaacggtcggaactattcgacctaccttaattttaaagttggtactacaacgtactacggaccgaacggggaccggacccccgtaagcctacctaacttctactcgactcgactacttaccgtagtttcgaacgtaacgggttcgggtacccagtcggtaggtacgagtgtacgagtaggatcggtaggactacggttattaccacgtctacacctatacgtaacgtactcgtacgactaacggtagtaagtttagttaccgtactttaaaccgttaacgtttacctaaccgttaactaaaccgttaaacgtttaactttaaaccgttaaacgttttccgggttttaaaccgggaaccggttaaacggtaccgaaccgtttaaacctaaacccgttaaaacgttaaaccggttacgtaggttaccgtacgtacgaaccgtaccgttagtttaccgttacgttaccgtttacccttaccgtttaccccgttacccgttaactacccgttacgttattaacccgg

SEQ ID NO: 143371 - DNA, 798 bp, Homo sapiens
  misc_feature: GYAE6OF02ILRJT.46.67.G01.1.454.CMB.1.raw
  modified_base (519)..(519): a, c, t, g, unknown or other
  misc_feature (519)..(519): n is a, c, g, or t
tcagactagcagtacacgaccggtgctcgatttagagtatacatattgggtttgggggacctcctgtgcaagaacatgaagcacctgtggtttgtccctcctgctggtggcagctcccagatgggtcctgtccctggtgcaactgcaggagtccgggccctaagactgggtgaggtccctttacgggacaccccttggtccccttcacccgtggcgccttggtcctctgggtactccctccaatcaggttaggttcggttttccttcggtcgggggtcttcgggggtcccggacacggtccctcccgaagggggacggggtcgttaggaaacttacgtagttagggtaaggttcgtcttactcgaagttacggtgggttaacgttacccttaagttaacgtacggtaccggttacctacttaacgaacgtaacggttcggtaacgtccaaccgtacgtactcgttaccgtacggacctaaccgtacaacggaactaactacgttacgttttaccccganaaggtagtacggttacgttacgttggtaccgtacccggtacgcgtacgaaccgggttacgggtacgttttaactacgttacggttcggaccgtagggtaaccgtaccggacttaagttactaggttttagttttacggtagtttacggtttagttaccgaaaccgttaccgtaggtaccggttacgggacggggttaaccctcccgggtaacccgtcgggaacccggtaggtaacgtacggtacgtaccgtaccgttccaccggttcgaccctaaccgg

SEQ ID NO: 143372 - DNA, 669 bp, Homo sapiens
  misc_feature: GYAE6OF02G41ON.46.67.G01.1.454.CMB.1.raw
  modified_base (243)..(243): a, c, t, g, unknown or other
  misc_feature (243)..(243): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttctctgggctgggtccgcagctccgagggagggctggaatcattggaatgtctctnatagtggacggttcctattacgacgtccgtctctcaagtagtcgagtcacctatatctctggacacgtccagtcaactcgtacgttttccctgaacgtatgacgttcgtgtcgaccgccgtctgacgtacgggtcgttttattacgttggtacgtacggagtacggtaccggtacttaacgtttagttacgttagttttttagggtaaggtttgggtttacgtttaccggtaacctacccgttaacggtacgtccgggtaccgggggtccttccgggaccccggtcggggacccgaagggtactacgttacggtccgtacccgttcgttaccgttacgtcccttaccgacccggtaccgggtacccctacgtaccggttccccttccccgtcggtacccctcccgtccctacccgtagacctaccg

SEQ ID NO: 143373 - DNA, 785 bp, Homo sapiens
  misc_feature: GYAE6OF02F0ZPK.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtcgggcccacgactggtgaggccttcggagaccctcgtcccctcacctgcgctgtctcgtggtcncctcatcgagttacggttggtttcttcgtggggtcgttggggtccgcagtcctaccggaggggacgggctaggaactacacgttaggaaggtcgtcttctcgtataggttaggtacggtttccgttaacgtttacgtacggttcccgttcttaccgtacaaggtacgtcggtacgttaccgaacctaagtacttccttccggtaggacccgtaaccgttccgagactaaacgttcgttaaccgtttttacccaaggtaacgtacgttacgttacgtttcgtacggtaccgaccccggtcgtcggtacggacggttaccgggtttacgtttacgtacgttcggtacggtacgtaacggtacgggtaaccgttctaagtttggttacgttttacggttttagggtcgttttaaggtttacgtttaccgtaacccgtacgtacgtaccgggtacggggtcccgggtccgttcccgggaacccggttcggggaacccgggtaagggttaccgttacgggttaccgtaccggttaacccggttccctaccggtttcccgacccttaaccccggg

SEQ ID NO: 143374 - DNA, 820 bp, Homo sapiens
  misc_feature: GYAE6OF02GJUQB.46.67.G01.1.454.CMB.1.raw
  modified_base (144)..(144): a, c, t, g, unknown or other
  misc_feature (144)..(144): n is a, c, g, or t
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattggggtttgggggagtctacgggtcaggacacagcatggacatgagggtccccgctcagctccgtggggctcctgctactcctggcctccggaggtcnccagatgtgacatcgagctgacccagtcctccactcctccgtgctagccgtaacgtggganactaggtcgtaccacactacctacgttcgggcccggganaacggttaccggaactacgtttacgaacctaaccgtttaaatttaaacggttagtaactactaaactaagtaacgaaccggtaacggggtaacccgtaccccgtaacggtacctaccttaacttacgttaacncggttaccgtacgtactaacgttaccgttacgtttacggtaacggttaaccgggtacgggttaacccgtacggttacggtaacggtttcgaacggtcgggacgtaaggtacgggtagtaacggtaggggaaccttaaggtacctttacgacttactacaaccgtactaacgacgttaagtcctacggaaccttaacggtaaggttaacgtttcgttaacgtaaccgtttaactttaacgttaacgttactaacggaaactttaaagttaaaccgttatttaacggtttacgttaaccggtaaccggtaaaaccggtaataaccccgtaaagttaaaccgttaaaacgtaaacggttacgttacggagttaccacggtacctaacgttagttctaccgtttattacccgtacgtttaccgcccgttataccgtatacgttaccg

SEQ ID NO: 143375 - DNA, 791 bp, Homo sapiens
  misc_feature: GYAE6OF02JNGA6.46.67.G01.1.454.CMB.1.raw
  modified_base (150)..(150): a, c, t, g, unknown or other
  misc_feature (150)..(150): n is a, c, g, or t
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggnggtccgggcccacgactggtgacggtccttcggacgtaccctcgtccctcacctcgcgcttcgtctcgtggtcncctcatcaggttgtcgtttctcggngggcgtcgggccgcacgccgtaccgagggaggtacgtaggaatacgtagttacggtagtgtccttactactagtcggtagggtcgttacttagtacgtcgtccgtctcgtanaagtcgtgtacgtacgactatacgtcgttgtacggactaccgacgatacgattaccgttacgtttccgaagtagtatcggtacgttccgtcgaccgtacccgccgtacgtgtaaccggtacgggttacgttttaccggtaacgttggtcccggtagggtaacgaaccggttcccggtaagtttaccgtttaaggttacggttttaaggtttacggttaggggttttacggtttaactttaacccggttaacgtaaccggttagaaccggggttttaaccgggaccgggggttacccgtacccggggtaccccgggtttaccggggtaaccgggtaaaccggggttaacgtttaacccgggtaacgggttccccggttttaacccggtacccgttttcccgggtttaaccccttccccgtaaaccccgggg

SEQ ID NO: 143376 - DNA, 530 bp, Homo sapiens
  misc_feature: GYAE6OF02FL2MT.46.67.G01.1.454.CMB.1.raw
  modified_base (302)..(302): a, c, t, g, unknown or other
  misc_feature (302)..(302): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttgccgggcaagtcgaacattgacacctatttaaattgtatcaacatagacaggacggcccctaagctcctaatctatgctgcatccagtttnacaagtggggtcccatcgagttcagtgcagtggatcgtggacagtattcactctacaccatcgagtaatctgacaacgtagaatatttgactaacgttacttactgtacaacagtaattactaattcgtttacgaccgtacggacacgactaacaaagttaaaccagtacgagtctagactaactactcttcgttacttacacttcttacccgactacttctagtaac

SEQ ID NO: 143377 - DNA, 904 bp, Homo sapiens
  misc_feature: GYAE6OF02HK8N4.46.67.G01.1.454.CMB.1.raw
tcagactagcagtacacgaccggtgctcgatttagagtatacatattggggtttgggggagtctcggtcaggacacagcatggacatgagggtccccgctcagctcctgggggctcctgctactctggctccggaggtgccagatgtgacatcgagctcgaccctagtcctccactcccttcccgtgtccgtcgaccgaaccggtggggaacgtaaccgaggttcgtaccaacccgtacttacctaaccggtttcggacccggggacgtaaagggtaccggaaactagttacgaacctaaccgtttaaattttaaaagttaggtaacttaacgaactaacgttaacggaacccggaacggggacccggacccccttaaggtccccttaccttaaacttacccgttaagtacgtacccggtcgacctaaccgttccgttaaggtttacggtaaccggttaaacgggttccgggggttacccctaaggttaccggtaacgggtttccgaagggttcgggactagggtaggtacggttaccggtacggggaactaggttacctttaccgacctctaaccgtacctactacgtaacgttaactccgtacggtaacgtacggtaacggttaaacgttagtttacgtaaccttaaacgttttacggttaacttaccggtaaactaaaccggttaattaaacggtttaacgttaaccgtttacgggttttaaccccggaacgggttaaaccgggtaacctaaaccggttaaaccttaaaaccgttaaaaccgttaaacggtaacgttacgggtacgttacctacggacccttaaccgttacgttccgtttaaccgttcccttttaaccgtcctttaccccggttacgacccgtttacttaacgtcgttaac

SEQ ID NO: 143378 - DNA, 738 bp, Homo sapiens
  misc_feature: GYAE6OF02FOMOV.46.67.G01.1.454.CMB.1.raw
  modified_base (174)..(174): a, c, t, g, unknown or other
  misc_feature (174)..(174): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctcactcctcctntctgcaccggtggganacngtgtacaccatctacttcggccgggacaagtaccggaactagttcgaacctaaccttaatttaaagtggttactacaacagtacgaacgtacgggaccgacccctaagaccttcctaatctatcgtctcggactacgtccttaaggttgaacgtaaacgggttccgggtacccagttcgggtaggttcaggtcgacgtagtggatcggaggactagtacttacacctactacctaacctctaactaagttacttccgtacggtaacctaaggtacgtaacgttactttaacggtaacttaaccttaacgttacttagtaaaccgttaacgtaaacgttaacgtttaacgtaaggttttcgttaaacccggacgtaaaccggggtaccctaaacgggtaacctttaaaacgaaaaccggtttaaacggttccgttagaccggttacctacggaccctttaagtaccgtttacgtacgtttacccggttaattaccccgttttaccgaacccccggtttataccggtttaaccgtaccggtttaacc

SEQ ID NO: 143379 - DNA, 934 bp, Homo sapiens
  misc_feature: GYAE6OF02JM91H.46.67.G01.1.454.CMB.1.raw
  modified_base (143)..(143): a, c, t, g, unknown or other
  misc_feature (143)..(143): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtnacatcgagctcgacccagtcctccacttccctcctgtctcgaccgtaaccgggtggacgacgaggttcgtaccaacccgaatcctaccgttcggaccccggggtaacctaaaacgggggtaccggtaaactagtttaccggaaccccttaaacccgttaaagtttttaaaaacgttcgggttaacttaacccgtaaaaccgtaagttaaccggtaaccccgggtaaccgggggtaaccccgggtaaccccccggttaaacggtacccccttaaccgttaaccgtacctttaacgtcgtccgtacgtaccgtcttaacccggttaagtttacgtaaaccggtaaacgggtttcccggggttaaccgtaacggttaccggttacggggttaccgtacgggtcggtacgtaaggtacggtaacgttccgggtaaggtacccgtaacgtttacgttaaccctacgttaccaaccgttaaccacgttacgtaagttaactacgtacgtaacgtaaacggtaacgttaacgttagtttaaccgaacttaaccgtttacttacttacgtaacgtaaagtacgtaaacgtttaacgttacgtttacggtttaccggtaaacggttaaccggaaccggtaaaccgtaaaccgtttaaaaccggtaaaacttaaacccggtaacgttaccgggttacgtaccgtaccgtaacggttaccctaaccgtttacgtaccgtttacttaccggttaaccctttacccggtacccgttactaacggtttaccgtaacgttaacccg

SEQ ID NO: 143380 - DNA, 870 bp, Homo sapiens
  misc_feature: GYAE6OF02HB5GU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggacccacgactggtgaggtccttcggagacccctgtccctcacctgcgctgtctctggtcgcctcatcgagtagttgtttcttcgtggggctcgggtccgcacgccgtccgaggggacgggcgtaggaactactaggttacggtaagtcgtcgttcctacgaagttaggtacgggttacggtttaccttaattacgacgttcccgtctcgtacgaaggtacgtacgacgtaccgaaccctattacttccgtacgtacggaacctaccgtaccgaagtacctaaacgttccgtttaaccgttttcccgtaaggtaacgtaggttacggttaacggttcgttcggtacccggacccggtacgtcggtaccggttacgggttaccggggtttactttttaacgtacgtttcgggtacggtaccggaagggtaaccggaaccggtttacgtttaaatttacggtttagggttttaagtttttacggggttaacggttttacggttttaaccgttacccggttaaacccgttaccgggttaaggtaacccgggttacccgggggtacccgggttcccgttaaccccggggtacccgggtacggggtaccgttaaacgggtaccgtttaaccggtccggtacccttaccgttccttaccgtccacccgtaccggtaaccggcccgtaccgttaccgttccccggttacccctccccggtccgtaccccttaccccgtaccgaacccgtagacccgtaccgg

SEQ ID NO: 143381 - DNA, 663 bp, Homo sapiens
  misc_feature: GYAE6OF02FH6KV.46.67.G01.1.454.CMB.1.raw
  modified_base (200)..(200): a, c, t, g, unknown or other
  misc_feature (200)..(200): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgccnctgtctcgtggtcgccctccatcagtagttcggtttcttcgtggggtctgggtccgctagcctacccgagggagggcgtaggaatacgcgttaggtaagtcgtactcgtacagtaggtcggtaggttcctatttaccgtacgtccgtctctacaaggtagtacgacgtaccgaactagtactcctacgtcgacgtacgtcacgactacttcctacgtttacccgtagaagtactagtacttcgtacgtacgccgtacgtacgtacgacgtacggttactttactacgttgtgtcgaggaccgtacgtctagttagtgtttagtttaggtacgttaggtttacttaccgtaacgtaccgtagtacgtccggtaccgggtcgtacccggtacccggtcgggaccgtaacggtacgtaaggtccggttaccgtacccgttcgtacccgttccgtacccgtaacccg

SEQ ID NO: 143382 - DNA, 743 bp, Homo sapiens
  misc_feature: GYAE6OF02FPAAS.46.67.G01.1.454.CMB.1.raw
  modified_base (437)..(437): a, c, t, g, unknown or other
  misc_feature (437)..(437): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatggtgacatcgagctcgacccagttcctccacttccctccctgtctcgaccgaaccggtggggacgactagtcgtaccaacccgtattccgtacgttcgggacccggggtaccgtaacggtaccgggtaaaccgtattccggaaacctaaccttttaaagttttaaaacgttggtaactaccgaactaagtacggaccgaacgggaccggtaccccgttaagccttacctaactcttagtacgtcgtacgactacgtccgtagttcgacgtaaggtccgggacctgtacgtagtgngtagtctaggtcggagtcgaggactagttactacgtctactccacgtactctaaggtactacgcgtaacgaacggttggtaacgtttacgttactaacctaacttttacttacggttaacttaaccgaattacggtaaacttacgttaacggtttaccggttaacggtaaccggtaaccggtaaccgtaacgttaaaccttaaactaaacgttaaaccgtagttacggtacgttaccgtgacctacgttcgttactacgttacctttactaccgtttcccgtccttacgtacgttccgtataccgg

SEQ ID NO: 143383 - DNA, 889 bp, Homo sapiens
  misc_feature: GYAE6OF02GCJP7.46.67.G01.1.454.CMB.1.raw
  modified_base (181)..(181): a, c, t, g, unknown or other
  misc_feature (181)..(181): n is a, c, g, or t
tcagactagcagtacacgaccggtgctcgatttagagtatacatattgggtttggggagtctcggtcaggacacagcatggacatgaggtccccgctcagctccgtgggctcctgctactctggcctccgagtgccagatgtgacagtcgagctagacccagtcctaccatcccgtccgtntctcgaccgaaccggtggaacgactagtacgtccaaccgtagtaccaacgttcggacccgggaacttaaacggtacccgaaacgttacgttaccggaaacctaaccgttttaaagttttaaaaccgtggttaaaccgttaacgaaaaaccgttaagttaaaccggaaaccccggtaaacggggtaacccccggtaacccccgttaaaacggtcccttaaacccggtttaaagtaaccccgttaagtaccggtacccgttaacggaccgtttaaccgttaaccccggttaagttttaccggaaaccggtaaaaacggggtttcccgggtaaacccctaagtttaaccggttaaacggtttaccgtaagggtccggtaaaccgtagggttaaccgggtaaacttcccggtaagggtaacccgtaagtttaccgttacgaaccgtttacccaccgtaacgtaaccgttacgtaacgtaactacgttacgaaccttaacggtaagtaacggtttactttaagtacttaaacgtttaacgttacgttaccgtaactaaacgtaaggttaacttaacgtagttacgtttaaccgaaccggtaacgaacgtaaacgtaaccgttaaaacgaaacgttaacgaagtacgtacgataccgactaacgtatccgtattccgtaacgttaccttccggtaccttacgcgtactaggtac

SEQ ID NO: 143384 - DNA, 970 bp, Homo sapiens
  misc_feature: GYAE6OF02FI6VL.46.67.G01.1.454.CMB.1.raw
tcagactagcagtacacgaccggtgctcgatttagagtatacatattgggtttggggagtctcggtcaggacacagcatggacatgagggttccccgctcagctcctggggctcctgctactctggctcgaggtgccagatgtgacatcgagctgacccagtcctccatccctccctgtcctgccaaccggtgggacacagttcgtaccaccctactctacgttcggccgggaccgtaacggtccggaactagttcgaacctaacccgttaattttaaacgttacggtaactaccaaacgtacgtaacgaccggtacgggaacccggtaccccctaaacggtcccttacccttaattaccttacgttcgtcctacgtacctaacttaccgttaacggttttacgaaccgtaaaccggggtccggggttaccctaacggtccggttaacggtttacgacgggttcggtccggtaaggtcggtacgtaccggttaggggaacttacggttaactttaccgtaacccgtttacctaccctaaaccctaacgtaccgtaacgttaacttaccgtcggtaaccgttaaacggttaacggttaaacgtttacgtttttacggtaaacctttaaaccgttaacgttttaccgttaacgtacctaaaaccgttaacgtaacgtttacgaaccgtttaagttttacccgggtttaacccggtaaccgtaaaaccggggttaaacccgttaaacccggttaaaccgttaaaaacccgttaaaaacggtttaaacccgggttaacccggtttaggttacccgggtacccgtaaccggttaaaccccgtaacccggtttaaaccggtttaaccccgttttacgggtttaacccctttttaaccccggtttaaaccccgtttaccccccgttttaaccccccgggttacccgttttaaacccgtttaacccggtttaacccgg

SEQ ID NO: 143385 - DNA, 956 bp, Homo sapiens
  misc_feature: GYAE6OF02GXG89.46.67.G01.1.454.CMB.1.raw
  modified_base (235)..(235): a, c, t, g, unknown or other
  misc_feature (235)..(235): n is a, c, g, or t
tcagactagcagtacacgaccggtgctcgatttagagtatacatattgggtttggggagtctcggtcaggacacagcatggacatgaggtcccgctcagctcctggggctcctgctactctggctccgagtgccagactgtgacatcgagctcgaccctagtcctccactcctcctgtcctgacgtaccggtgggacgactaggtcgtcaacctatccgtacgttcggccggtanaaggtcggaactattacgaacttaccgttaatttaaacgttggttactacctaaactaacgtaacgaccggtaacggggacccgtacccgtaaacgtccgttaacccttaacgttccgttaacgttcggtacctacggtacctaaccttcccggttaaggtttaccgaccggtttaaacgggtcccggggtaccctaacggttccggtaacggtttccgtaacggttccgaacggttacgggtaccggtacggttacggttacggggaacttaagttaccggtttacccaacccgtttacgtacccccggttaaacgttacccctttaagggttaaaccgttttaacctaccgtttaaccgggtaaaccgttttaaaccgggtaacgggtttaaaacgtttaccggtttttaaaccgaacggttttaaaacccgttttcggttttaaccgtacggttaaacccgtaaacgtttaaaaccggtttaaacgttttaccgtaaaaccgttttccggggttttaaccggaaacccgggtttaaacggtaaaccgttaaaaccccggttaagtttaaaaaccccgtttaaaagttaaaacccggtaacggttttacggaccgggtttacccttaacggtcccgttaaacgttcgtttaacccgtcctttaaccgtttactaccccgttaccgttaccccgtaacggttactttaccgacgtttaac

SEQ ID NO: 143386 - DNA, 751 bp, Homo sapiens
  misc_feature: GYAE6OF02GBPI7.46.67.G01.1.454.CMB.1.raw
  modified_base (133)..(133): a, c, t, g, unknown or other
  misc_feature (133)..(133): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttggggagtctcggtcaggacacagcatggacatgagggtcccgctcagctcctggggctctgctatctggctccgaggtcncgagatgtgacatcgagctcgacccagtcctcctactccctcccgttgttcgtcgaccgtaaccggtgggacactagtcgtaccacctactctaccgttcgggccgggactaacggtaccggtaactagttcggaacctaaccgttaattttaaacgttacggtacttacgaaactagtacgtacgtacggaacgggacccggtaacccctaaggtaccttaccttaaaacgttcgttaaacgtcgtacgttcgacctactaccgtacgtttcggaacgtaagggttcccgggtacctacggttcggacgttcgtaggtcgtacgaggtcgtaggtcgtaggagtacgttaacttcacttcgactactnactaacttactcgtacgataacggtacttaaagttctttacgtaacttaacttcgttaacgttacgtactaaacgttaacttaacttaaacttaacggtttggttaaacccggaacgggtaaccgtaaccgtaaacgtaaaccgttaaaccgtaaaagttaaccgggactttacggacgttactaacgtacctaacgttcgtaacttaccgttacttccgtacctttcccgtactactcgtagtaaccg

SEQ ID NO: 143387 - DNA, 712 bp, Homo sapiens
  misc_feature: GYAE6OF02IK5HZ.46.67.G01.1.454.CMB.1.raw
  modified_base (656)..(656): a, c, t, g, unknown or other
  misc_feature (656)..(656): n is a, c, g, or t
  modified_base (665)..(665): a, c, t, g, unknown or other
  misc_feature (665)..(665): n is a, c, g, or t
  modified_base (676)..(676): a, c, t, g, unknown or other
  misc_feature (676)..(676): n is a, c, g, or t
  modified_base (692)..(692): a, c, t, g, unknown or other
  misc_feature (692)..(692): n is a, c, g, or t
  modified_base (700)..(700): a, c, t, g, unknown or other
  misc_feature (700)..(700): n is a, c, g, or t
tcagactagcagtacacgaccggtgctcgatttagagtatacatattgggtttggggagtctcggtcaggacacagcatggacatgagggtccccgctcagctcctggggctcctgctactctggctcgagtgccagatgtgacatcgagctcgacccagtcctccactccctcctgtctgaccgaccggtggacgactagtcgtccaccgtactcacgttcggacccgggactaacggtcggaactacgttacgacctacgtttaacgttttaaagtggttactactaaaccgtagtaaccgaccggaacggggtaccccgtaaccccgtaacgtccgttaacctaacgtacgttacgtcgtccgttacgtaccgtattacccgttaggtttcgaaccggtaaacgggttccgggtaacctaggtaccggtacggttagacgggtcggtaccgtagggtcgacgttcggaacggtacgtacgttaccgttctacgttaccacctaaccgtagtccgtaacggtactcggtaacgtcgtaaacgtagttaacgtttattaccgtaactttaacttacgttaactagtacctaaggtaacttacgttagtaacgtttcgggtaccgaagtacgacctaagtacctaaataaccgtanacgtgactnacgtcacttgnttactactcgttaccncgtaccgntagtcctagtac

SEQ ID NO: 143388 - DNA, 767 bp, Homo sapiens
  misc_feature: GYAE6OF02FZRHI.46.67.G01.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgacgggtccccgctcagctcctggggctcctgctactctggctcgagtgccagatgtgacatcgagctcgacccagtctccactcctcctgtcngctaacggtgganacngtgtcactatcacgttggaccggataacggtcgaactgttacgaactaccgttaatttaagtggtactacaaacatacggaaccgacggaccgaccctaacgccttacctaatccgtatgacgttgacctacgttacccgtagtttacggaacgtaaacgggttccgggtaaccctagtacgggttaacgtcgtacgggcggtagtggtacgggtactcgggtaacggtactacgttatttaacccgactccgtaccactaacgtcctaagttacgtcgttagaacgtagtaacgtaacgtttagtttaccgtaaactttaaccgttagtttaaccgttacgttaacctaactaaagttaacctttaacgtaacggtttttaccggttaaccggtaaaccggttaagggtaaaccctaacgttaaaccgttaaaaaccgttaaacgttaaaccgttaaacgttccggaacgttacgtaaacgtacccgttaaacttccggttaacgttccggttacctttaccgggttacctttcccgtttaacccggctttaaccgtagttaccggttaac

SEQ ID NO: 143389 - DNA, 1059 bp, Homo sapiens
  misc_feature: GYAE6OF02H58YK.46.67.G01.1.454.CMB.1.raw
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
tcagactagcagtacacgaccggtgctcgatttagagtatacatattgggtttgggggacctcctgtgcaagaacatgaagcacctgtggtttgtcctccctgctggtggcagctcccagatgggtctgtccctggtgcaactgacgagggacggtccggaccctacgacgtggtggacggtccttcggaacgtaccctcgtccctcaccttgcgctgtctctggtctcctcntacgagttaggttcggttttcttcggtcggggtctggggtccgncggtcctaccggaggggacggggtcgaggtaatacgtaaggttcgggagtcgttactctacgtaacggtaggtcgggttaccggttaccttaagttacggaccggttccgttcctacctagaacggtacggtccgtacgtcctaaccgattaccgttcgtacggttacgccgtaaccggtcctaaaccgacgttaaacgtcccgtttaaaccgttttcccgtaaacggggttaaactccggggtttaacgttttacccggtttaacgtacccggggtaccccggtacccccgtacccgggttcgggttaaccggtaaaccccgggggtttacggggttttaaaccctttttaaccggtttttaacggggaccgggttttaccggggggttaacgttaaaaccgggggaacccgggtttaaccgggttttaaaccggttttaacttttaccgggggtttacggggtttttttaacgggtttttacgggtttaacggggtttttaacggttttaaccgttccccgggttaaaacccctttaaccggggttaaaccggttaccccggggggggttaaaccccggggttacccccgggggggtttacccccttacccccggggggtaacccccgggggggtttaccgggtaacccgggggtttaaaaacccggggttttaccctttaccggggggttacccctttaccccccggggtttaaacccggtttttcccgtttaaaccccccggggtacccggtttaccccccccttaaaaccccggggg

SEQ ID NO: 143390 - DNA, 1041 bp, Homo sapiens
  misc_feature: GYAE6OF02GKGXN.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattgggtttgggggaccctcctgtgcaagaacatgaagcaccgtgtggtttgtcctcctgctggtggcagcctcccgagatcgggtcctcgtcccgtcggtgccaactgcaggaggtccgggcccacgtacgtggtgacggccttcggacgaccctcgtccctcacctggccgtctcgtcttccgtgggtccnccctaccagtacgtacggttacggttcggttttacctacgggtgggggtccgttacggggtccggacgtacgtccccggtaaccgggaacgggggtaaacggggtccgttagggtaaacgttaaccgtaaggtttaagggaacgttcggttaccttacgtacgtaagttacggttacgggttacggtttaaccgtaacgttaccgtaacggttcccgtacgttaccgtacgaaacggtacgtaccggtacgtaaccgtaaccgtaagttaaccgtcgttaccggtacgtaaacccgtacccggttaccgaacggtaaccgtaacgtttaccgtttaacccggttttacccgaaaggtaaacggtacggttacgttaaccggtttacgtacgggtacccggtaacccggtcccggttaaccggtaaccgggttaacccgggtttaaccggggtttaacgttttaaaccggttaccggttacgggttaaacgggccggttaaaacgggttaccgggtaaccggtttaacgtttttaaaccgtttagggtttaaaccgggttttttaaggttttaccggggttaaaggggttttttacccgttttaaccggttaaaccccgtacccggtttaaaccggaacgggtttaaccgggtacccggggggtacccgggttaacccgtacccccggggttaccggggttaaccggggtaaacccggtaagggttaacccgttacccgggttacggtaaccccggtttaaccccgtttacgtaaccccggttacccgtaacccctaaccccggg

SEQ ID NO: 143391 - DNA, 945 bp, Homo sapiens
  misc_feature: GYAE6OF02FP38U.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaccgtggganacagtgtcacctatcctacttcggccgggtacaacggtccgggaaactatttacggaacctaacccgttaattttaaaagtttcgggttaactaccgaaacctaagttaacggaaccggaaacgggggaacccggtacccccttaaacggtacccgttacccttaaaacgttccgttaagttcggtaccttcggtacctacgttacccgtaagggtttttacgaaacggtaaaacgggttccgggggtacccctaagttaccgggttacgggtttaccggtaagggttacgggtaccgtaagggttcgggtacgttaccggttacgggggtaactaacgggttaactttaccgtaaccgtttaccctaacccgaccggttaaccttacgtaaacggttaacctttaccgtacggttaacctaaaccgggtttaaggtaaaggttttaaccttttacggtaacccgtttaaaaccttttaacgttttaaccgtttacggtaaacccgtaaacgttaacgttaaaactttaaccgttaaaggtttttacggttttacccgggtaaccggtaaacggggtaaaccttaaccggttaaacccttaaaaacgtttaaaaccgtttaaaaaccgtaacgttaggtaacggtaccttacggacccgttaaacccgtacgttacccgttaaggtttaccgtttacccgttaactttcccccgtttaccccgtacccgttaacgtttacccggtagttaaccgg

SEQ ID NO: 143392 - DNA, 649 bp, Homo sapiens
  misc_feature: GYAE6OF02ILFOU.46.67.G01.1.454.CMB.1.raw
  modified_base (98)..(98): a, c, t, g, unknown or other
  misc_feature (98)..(98): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
tcagactagcagtacacgaccggtgctcgatttagagtatacatattggggtttggggagtctcggtcaggacacagcatggacatgagggtccccgntcagctcctgggggctcctgctactctggctccgaggtcgccagatgtgacatcgagctcgaccagtctccatcctcctgtctcgaccacggtggacacgagtgtaccactactctaccgttcggccggacaacggtacggaactagttcgactaacgttaattttaagtggtatactaaatacgtaacggtaccgacgggtaccgacctaagtcctacgtaactntagcncttgacctactcgtaggttagaccgtaaggtcggtacctntacgtagtcgtagcgctaggtacgtntacgacggtacagtacttacacttacgaactactagtactagttaccgccgtaagaccgtaacgttagtaaagtttacggttataaaccttaagtttccgaagttactaacaaacgtaaacgtaatttaaccggacgtttacgtaaacggacgtaaacggcttaacaacgtttaacaaaggtacgtaacgtgtacgtacctagaccaacttgctgttacctccgtaacttcccgtaccgacttagactaggtac

SEQ ID NO: 143393 - DNA, 831 bp, Homo sapiens
  misc_feature: GYAE6OF02FIGY3.46.67.G01.1.454.CMB.1.raw
tcagactagcagtacacgaccggtgctcgatttagagtatacatattgggtttggggagtctcggtcagacacagcatggacatgagggtccccgctcagctcctggggctcctgctactctggtctccggtaggtcgaccagtactgtacgactagtcggtacgcgtacgaccccgagttcctacccgtactccctccctggtctaccgtacgaccggtgggacgtacaggttctacacctagtcctacgttccggccgggtaccaacggttaccggaactcgttacgaccgtaccttaatttaacgtggtaactacaacgtacgtacgaccgtaacgggtacccggtacccctaacggtaccttaccgttaactactaacgttcggtcctacgtaccgtaacttaccggttaagtttacgaacggttaaacggtccgggtacctacgggttaccgttaaggtcgtacgggtcggtaccgaggttccgtagttaccggtacggtacgtacggtttacttacccgaacctccgtaccgtaacccttagtaccgtaacggttaactcgacgtaacgtaacggtaacttaggttaccgttacgtaaccgttacttaccgttcgttacctaacgtaacgttaacgttaaccttacgttaggtttaccggttaccggaacgtaacggtacccgtaacgtaaccttaaacgtaaacgttaaacggtacgttccggttacgtacgtaccgtaaccgtacccgtaactttcgtacccggtttacttacccgtacccgtttaccggtaaccccgtctacgggttacctacggttaaccg

SEQ ID NO: 143394 - DNA, 613 bp, Homo sapiens
  misc_feature: GYAE6OF02F3C34.46.67.G01.1.454.CMB.1.raw
  modified_base (487)..(487): a, c, t, g, unknown or other
  misc_feature (487)..(487): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgacgtggtgaggccttcggacgaccctgtccctcaccgtgcgctgtctctggtcgtccctcatcagtagttggtttcttcgtggggtctgggtccggcacgccgtccgaggggagggctaggaactacgtagttggaagtgtctcgtctagtaggtggtacgttctattacgtacgtccgtctcgtacagtagtcgtacgtaccactatactcgtactcgacctacgtccacgacaacttctacgtttccaggatagtcgtagttccccgtgtcgccgccgtcgtcgtacggtacggtacgtttagtactgtcgcgagacgtacgtntattagtgttagtttggtgttagttacgttcgtacctacgtagtacgtcggcgggtcgtccggtccggtcgggtacggtacggtacgtacgtcggtaccgtcccgtctaccgtacgtccgtacccg

SEQ ID NO: 143395 - DNA, 662 bp, Homo sapiens
  misc_feature: GYAE6OF02F5WIS.46.67.G01.1.454.CMB.1.raw
  modified_base (225)..(225): a, c, t, g, unknown or other
  misc_feature (225)..(225): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgccaaccggtgggagacagtcgtcaccatcacttcggccggganaaggtcggaactattacgacctaaccttaatttaaagttggtatcaactatacgaccgagggaccgacccctaagcctactaatctatgctgctatcctagttacgacgtaacgggtcgggtacccagtcggtaagttcacggttggactaggtggacttcggagggtacagttacttcgacttccgtactactacttacagttaactcgtagacgtaacggtagtaacgttatttacgtaacttaacgttattaacgtgtaacaactaagttaaacttacgttacgttacggtttaccggaacgtacggtaacacggtaactaaacgtaaactaaacgtagtagggtaccgagtacgtaccgtaacgttactccggttacgttaacctttaccgtaccgtttacccgttccccgtactaacgttctaagttacccg

SEQ ID NO: 143396 - DNA, 766 bp, Homo sapiens
  misc_feature: GYAE6OF02I7JCF.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgcaaccggtggganacagtcgtacaccatcacttcggccgggacaaggtccggaaactagttacggaacctacctttaattttaaaacgttggttaactaccgaaactaagttacgaacccgaacggggaaccggaccccccttaaaggcctttacccttaaagtccttaagtcggaccttgtacctaacgttacccgtaggttttacgaaccggtaaaacgggttcgggttacccccaagttccgggtaggttaccgtaaggtcggaccgtaggtcgggtaacttccggtagggaactaggttaacttttaccaaccgttcctacctaacctagttaccgtagttaactccgtagtaccgtaaaggttagtaacgttattttacgaccttaaacgtttacttactacgttaaccaaacgttagtaaactttacgtaaagtttcggttaccggtaaccgaagggtacctaacgtaacgttaaactaaacgttaaacgtaacttaggtcgtacgtaacgtaccaaccgttattccgtagtttacctaccgttacttcccgttacccgacttacgtaccttacgtaacg

SEQ ID NO: 143397 - DNA, 879 bp, Homo sapiens
  misc_feature: GYAE6OF02JI4HK.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgacccagtcctccatccctccctgtcctcgacgaaccggtgggacacgagtcgtaccaacctatccgacgttcgggacccgggtacaaaggtaccggaaactagttacgaccgtaaaccttaagttttaaaaggtcgtaactacgtaaacctagtaaccggtaaccggagggtaaccccggacccccttaaaggacccttaccgttaactaccttaacgttcgaccgttaggaccctaacttaccgtacggttttacgaaccggtaaaccgggtccggggtaccccttaaggtaccggttaacggggtttacgacgggtacggaccggtaaggtaccggtacgtaccggtaacgggtaactaaacggttcctttacgtaacccttccgtaaccctaaacgtagtacccgtttaaagtacctacggttaacccgtacgggtaaaccgtagggtaaaccttacggtttactaaccgtttaaaaccgttttacgttaaccgttacgttaaaaccgaacgtttaaaccttaaagttaaccgttaacggttttacggtttaacccgggaacgtaaagggtaccctaaacgttaaaccgttaaaaccttaaacggttaaccggaaaccgttcgtaaccgtaccgttaacgaccgttaacgtaacgtccgtttacgtaccctttacgtccttaccccggttccgtaccctacgttaccgtgttaaccccg

SEQ ID NO: 143398 - DNA, 855 bp, Homo sapiens
  misc_feature: GYAE6OF02GND9X.46.67.G01.1.454.CMB.1.raw
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgacggtccttacggacgaccctgtccctcaccgtgcgtcttgtctcgtggtcgtcctcatcagttagttggtttctcgtgggtctcgggtccgctacgccgtaccggagggggtaacgggtctaggaactcgtagtgggaacgtntcctctanagttacggtggtacgttaccttaattccgtacgttcccgttaacgtactacggtaagtacgggtcgtacttacccaacgttaagtacttccgtcggtaccggtaaaccgtaaccggttacccgaggtaacctacgttacgttacccgtttaccgtaggaaaagtccgttaggttacgtttaccgtacggtaccggaacccgtaccggttacttacgggaaaccccgggtttacggggttttacttttaaacccgttggtcccgggtttaaacgggccgggtaacgggtaacggtaaccgggtaaccgtttaagtttaacgtttaacggttaacgttttagggttacggttacgtttaacgttacgtaaccgtacgttacgtacggttacgggaccggtaccgtaccggttaccggtaccgggtaccggtaacgggtacgttacggttccgtaccgtaccggttaccgttacgttaccgccgttttaccgaaccgtaaccggtaccgtccgttaccggttcccgttaccccgtccggtacccgttcccgtaccctaacggaccgtaccgtacccgg

SEQ ID NO: 143399 - DNA, 763 bp, Homo sapiens
  misc_feature: GYAE6OF02IC3QO.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttggacgaccctgtccctcacctgcgctgtctcgtggtcgcctcatcgtagttacgttggtttcttcgtgggcttcgggtccggcgacgccgtaccgagggacggcgtaggatacgagttaggaacgtgtctctacgagtaggtggtacgttacctagttacacggttccgtactactacgaagagtacgtaacgtacaccctaatacgttacctcgtacggtaccgtaaccggtccacgtactaacgtcttaaccttttcccgtaagtaaagtcgtaaggttacgttcgtaggtaccgacccgcccgtacgacggaacgtacggtacgttttacgtacgttggtacgacggtagtaacgaccgttattaacgttagttaggtttagtttgggtaacggtttgttttacttaccggtaacccgtcgtaaggtacggttaccgggtaccgggtaccgttacccgggaccccggtagggaccgtaacggggtaacgttaccggttaccgtaccgtaccgtaccgtccgttaacctcccgttaaccgaccggtaccggtacccgtaacggttccccgtttacccgtccccgacggtacccgtaccccgttcccgtaacgacccgacgtaacccg

SEQ ID NO: 143400 - DNA, 630 bp, Homo sapiens
  misc_feature: GYAE6OF02F62AS.46.67.G01.1.454.CMB.1.raw
  modified_base (326)..(326): a, c, t, g, unknown or other
  misc_feature (326)..(326): n is a, c, g, or t
  modified_base (404)..(404): a, c, t, g, unknown or other
  misc_feature (404)..(404): n is a, c, g, or t
  modified_base (446)..(446): a, c, t, g, unknown or other
  misc_feature (446)..(446): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacggactggtgaggcctttcgggacgaccctgtcccctcacctgcgctgtctcgtggtcgacctccgatcgagtagttggtttctcgtgggctgggtccgcagctccgagggagggctggaactacagttggaagtgtctcgtcataggtggtacggttcctattacncgttccgtctctacgaagtacgtcgagtccactatactctcgtcggacacgtcagactactctacgtttccagaagtntcgtacgttcgtgtcgaccgccgcgtacgacggtacgggttntttaacttaccgtggttcgacgtaggacggtacgtatttagttcgttaggttacgttttggagtttcggtttacttaccgactaccgtagtaccgtcgggtacgggtcctccggtacccggtgggaccgtaagggtactcggtcggtaccttaccggtcccttaccgttaccgccctaacccgg

SEQ ID NO: 143401 - DNA, 1144 bp, Homo sapiens
  misc_feature: GYAE6OF02F8IDW.46.67.G01.1.454.CMB.1.raw
  modified_base (151)..(151): a, c, t, g, unknown or other
  misc_feature (151)..(151): n is a, c, g, or t
tcagactagcagtacacgaccggtgctcgatttagagtatacatattgggtttgtcctcctgctggtggcagctcccagatgggtcctgtccctggtgcaactgcaggagtccggcccagactggtgaggccttcggagaccctgtccctnacctgcgctgtctcgtggtcgcctccatcgagtagttggtttcttcgtggggtctcggggtccgcacgtcctacccggaagggggaacgggtctagggaaactacgtagttacggggaagttcgttccttaccgtacgtaagttagggttacgggtaacggggttttaccccttaattttaaccggtaacgggtttccccggtttaccttaccgtaacccgtaaagggtaacggttacccggtaacggttacccaaccccttaaggttaaccttttcccgttaccggtttacgggaacccgttaaccccggtttacccgaaacgggtaccctaaaacgtttcccggtttaacccgggtttttttaccccccgaagggttaaaacggtaaccgtttacggtttaacggttttaccggtttacgggttacccgggtaacccccggttaccccgggttaccgttaaccgggtaaccccgggtttaacccgggggggtttaccgtttttttaaaccgtttaaccggttttaccgggtaccgggtaccggtaacggggtaacgggtaacccggggtttacgtttaaaccggtttttagttaacgggttttaacgggtttttttaacggggttaacggggttttacgggtttttaaaccggttttacccggtaaacccggtttaccccggtttaaagggttaacccgggttacccggggggttaaacccgggggtaccccgttttaccccggggtaaccccggggtttaccgggggacccgggttaacggggtaaaccgtttacccggggtttcgggtaaccccgttaaacccggtttcccgttacccggtttaaccgtaccccgttaaccccgtaacccggggtaaccgggtacccccgttaacggttcccccggtttaccccggtttacccccggtacggttcccccgttaacccccgttccggtaaccccggtaaacggtacccggttacccccgg

SEQ ID NO: 143402 - DNA, 740 bp, Homo sapiens
  misc_feature: GYAE6OF02I1WTK.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggcctcggaggtcgccagatgtcgactagtcgagctcgaccctagtccgtccacgttccctccgtagtcctacggaccgaaccggtgggacgactgttcgccaactacgtcgtacgttcggacccggactaacggtccggtaactcgttacgacctacgtttaatttaacgtggtactacaacgtactacggaccgacgggaccgtaccccgtaagtcctacgtactcgtacgtgtaccgtgtactacctcgttaacgttacggaacggtacggtccgggtcctacgtacggtactcggtaacgtcgtacgtaggttcgacgttacggtaggaacgtacgtctttacgacctcgtaacctacgtacgtaccgtagtactcggtacgtactaacggtacgttaacgttacgttcgttaacttacgtttacttaacgtacgtaacgtactaaacggttaacttagtaccggttttcgaaccgggtacgaaccggtaaccaacgttaaccgtaacgtaaacgttaacgtacgtagttaccgactacgtacctacgttacgtcgtttaccgttactaccgttaccgttcccgaaccgtagttacccgtgtaccgtaacgg

SEQ ID NO: 143403 - DNA, 604 bp, Homo sapiens
  misc_feature: GYAE6OF02FMMD5.46.67.G01.1.454.CMB.1.raw
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
  modified_base (522)..(522): a, c, t, g, unknown or other
  misc_feature (522)..(522): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtcgcagcctccgagggagggctaggaatacgagttggagtgtctctcagtaggtggacggttcctaattacagtccgtctctagaagngtacgagtccacatactctcgtgactacgtcagcaatctacgtttcccagaanagtgtagttctgtcgaccgcgctacgacgtcggtctttatcgtggtagcgagtacgacgtctagttagtgttagttttggaggttagttacgttccgactaccgtagtacgtcgggacgggtcctccggacccggtgggaccgaggtactacgtcggtacctaccgtcgtccgtccnccctaccgacccggtacggtccctcggttccccgttccccgttcccgtcgacccctaccctccgtacctaacgcctacccgg

SEQ ID NO: 143404 - DNA, 731 bp, Homo sapiens
  misc_feature: GYAE6OF02HL7JZ.46.67.G01.1.454.CMB.1.raw
  modified_base (154)..(154): a, c, t, g, unknown or other
  misc_feature (154)..(154): n is a, c, g, or t
  modified_base (173)..(173): a, c, t, g, unknown or other
  misc_feature (173)..(173): n is a, c, g, or t
  modified_base (716)..(716): a, c, t, g, unknown or other
  misc_feature (716)..(716): n is a, c, g, or t
tcagactagcagtacacgaccggtgctcgatttagagtatacatattgggtttggggagtctcggtcaggacacagcatggacatgagggtccccgctcagcctccgtggggctcctgctactctggctcggaggtgcagatgtgacagtcgancgtcgaccctagtcctacnctcctcctgtctcgacgacggtggatacgagtcgaccactactactacggttccggccggtacgtaacggtacgaactaacgttcgaaccttaaccgtttaagttttaaacgttggttaactaaccaaagtacgtaacgtaccggaacgggtaccccgaccctaagtccctacgtaatacctatacgtcctagtactaccgtccgttattacgaacggtacgggttcggacccttgtaccggtgttacgtaggtgaccgttaggtggacgttacggtaggacttaacggttacctcttaccgacgttaacccgactatacgtaactacgtacggtactacgtaagtacgtaattcttaacgtaccttaattaccgtagtacgtaacattaattaaccgttatacgtttaccgttaacggacggaacgtaacgtaactaacgtaaacggttaaaactaacggtacgttacgcggtaaccgtacgtacctaccgttacgttacgttccttaacgttcccttaaccgtttcccaccggtttaaccngtttaccaccgttcg

SEQ ID NO: 143405 - DNA, 1007 bp, Homo sapiens
  misc_feature: GYAE6OF02I17HZ.46.67.G01.1.454.CMB.1.raw
  modified_base (177)..(177): a, c, t, g, unknown or other
  misc_feature (177)..(177): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagactagcagtacacgaccggtgctcgatttagagtatacatatttgggtttgtcctcctgctggtggcagctcccagatgggtcctgtccctggtgcaactgcaggagtccgggcccacgactggtgaggcccttggagaccctgtccctacacctgcgctgtctcgtggttcncctcgactcagttagttgtttctcgngggcgttgggtccgnacgccgtaccgaagggtacgggctaggactacgtaggttcggaagttcgttctacctgaacgttggtcgggttacggtttaccttaacgttaccgtacggttcccgtacttaccgttaacgaagggttaacggttcggtaaccggtacctaaccagtttaacttcccgttacgtacggtaaccctaccggttaccgacgtaacaacgttcgtttaccggtttttaccctaagggtaaaccgtaaggttcggttacggttttccgtacggtaccggttaccccggcccggttaccgtacgggtaaccggttaacccggggtttacttttaacgtttaaccggttcggtaccgggtcggggaaacggttaacgggtaacccggttaagttttaaacggttttaaggtttacggttttaaggttttaaccggggttaggttttttaccggttaacggtttttaacccggtaaccgtttaaacccccgttagggttaacggttccccggggggttacccgggggtacccggttacccggggtaacccccgggtttaccggggaccgggttaaaccgggttaacccggttacggttaccccgggttacccgtaaacccgggtttccctttaacccggtttaaccggttccccggtttaaccccgtaaaccgggggacccccggtttaacccggttaccggtttaaccccgggtttcccccgtttacccccgggtacccggtacccgttacccccggttacccggtttaacgaccgggttaccccgtaccccggg

SEQ ID NO: 143406 - DNA, 866 bp, Homo sapiens
  misc_feature: GYAE6OF02GTX21.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgacctgggtgaggccttcggagaccctgtcccctcacctgcgctgtctctggtcgccctccatcagtagttggtttcttcgtggggcgttggggtccgnacgcctcccgagggggaacgggctaggaactacgagttaggaagttcgtcctctactagtaggtggtacggtttcctaattaccgacgttcccgttcgttactaccgaagacggtcgagtccaacctattactcgtacgtcggaccaccgtaccagactaattccgttacgttttcccaggaagtatggtacgttcgtggtaccgtacccgccgtcgtacggaaccggtcggggtttacgtttacgtttacgtgggtacggcgggtaagtacgggtaaccgtacgtttaagtttaagtttcggttttagtttttacggggttaggttttacggtttttaaccgtttaccggtaacccgtttaaccgttaacgttacccgggttaccggggtccggggttcccgtaaccccgggtacccggggttaccggggaccggtaacggggttaaacgttaccggttaccgggttaccccgtccggtttacccgttcccgtttacccggtaccccgttaacccccggtaaccgggtaaacccgggtacccccttacccgggtttacccccggtttcccccgtttaccccccgggttaccggtaccccccttaccccgtccccgtaaccggttaacccggtcccgtaaccccgg

SEQ ID NO: 143407 - DNA, 837 bp, Homo sapiens
  misc_feature: GYAE6OF02FLWHB.46.67.G01.1.454.CMB.1.raw
tcagactagcagtacacgaccggtgctcgatttagagtatacatattgggtttgggggacctcctgtgcaagaacatgaagccacctgtggtttgtcctcctgctggtggcagctccagatggtcctgtccctggtgcactgcaggacgtcgggcccacgtactggtgaggtccttcggacgacccgttgtcccctcacctgccgtcgtgtcctcgtcgggtacgccctccaattccgaggttacggttcggttttccttcggtcgggggtccttcgggggtccccggactacggtcccgtaccccggagggggtaacggggtccgtacgggtaaacttacgtagttagggaacgttcggttcctaccgtactagttacggttacgggtaacggtttacctaacgttaccgtaccgttacccgtccttaccgtacgaaacggtacgtccggtaacggttaccctaacctaacttacttaccgtacgtaccgggtacctaccgtccgaacggtaactaaccttccgttaaccggttttaccctaaggtaacgtacgttaggtacgtttcgtacggtccgtacccgcccggtacgtaccggtaccggtacggttacgtttaccgtacgtcgtacgacggtacggacggtttttaccggactttacgttacgtaggtttagttttgggtagtttacggtttacgtttaccgaaccttaccgtaagtacggtacgggtaccgggtccgtacccgggtccggtaccgggaccggtaacggtaaccgtacggttccggttaccgtacccggtttcccgtaccgttacccgtacccgtacccgg

SEQ ID NO: 143408 - DNA, 918 bp, Homo sapiens
  misc_feature: GYAE6OF02JPKDP.46.67.G01.1.454.CMB.1.raw
  modified_base (201)..(201): a, c, t, g, unknown or other
  misc_feature (201)..(201): n is a, c, g, or t
tcagactagcagtacacgaccggtgctcgatttagagtatacatattgggtttgtcctcctgctggtggcagctcccagatgggtcctgtccctggtgcaactgcaggagtcgggcccacggactggtgaggccttcgggacgaccctgtccctcacctgcgctgtctctggtcgcctccatcagtagtcggtttcttcgngggctgggtccggcagcctccgaggggaacgggtctagggaatcgtagttcggagtcgtctctacagtagtggacggttcctattacgacgttccgtctctacaagtagtcgagtccaaccgtatacgtctacgtacggtactaaccgttccgaagtaccgtaaattccgttaccggtttttacccccgtaggtaaaacgttaccgtaggttacggtttaccgtttaggtaccggtaaccccggtccgtacggttaccggtaacccgggtaccgggggtttacctttttaacgttaaccgttgggttaccggtaccggtaaagggtaacccggggttaccggttaacccgtttaaaggttttacggttaacgggttttaacggtttttttagggggttaaccgggtttttaacggggttttaaccgtttttaaccgggtaaccctttaaccccgggtaaacgggtttacccgttaaccgggggtaacccgggggttacccgttacccccggggtaaaccccgggttcgggggtaaccccggtaacgggggtaacctttaaccgggtaccggttccggtaaacccggtttccctacccggtttactacccgggtaccctaaccgggtaacccgggtacccgtacggttccccgtcccggttttacccgaccgggttcccctaccccgttacccgaacccgtacggtcccgtaccccgg

SEQ ID NO: 143409 - DNA, 762 bp, Homo sapiens
  misc_feature: GYAE6OF02HNS9D.46.67.G01.1.454.CMB.1.raw
  modified_base (473)..(473): a, c, t, g, unknown or other
  misc_feature (473)..(473): n is a, c, g, or t
  modified_base (686)..(686): a, c, t, g, unknown or other
  misc_feature (686)..(686): n is a, c, g, or t
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctcgacccagttcctcctactcccttccctgtctacgaccgaaccggtgggacgacgtaggtcgtaccacctataccgtacgttcggggcccgggactaaacgggtccgaaactacgttacgaaccttacctttaaattttaaacgttcggttaataaccgaactaatacggaccgtaacggggaccggtaccccctaaggtccttacctaatctacgtcgactcgacctacgttcccgtaagtttcgacgaaagggttccgggtaccctagtaccgggtagtttcggacggtggtaccggtaggtacggacgttcggngggaactaggtttacttaccgtacctacgtacccacgtacgtaacctagttactccgtacgaacgtacgtagtaacgttagttacgtacttaacgttacttacgtactacaacgtaagtaacttaacgttaagttcgttaaccggacgtaaggacccgtaaacgtaactaaacgtaaacgttaaaccgagttacggtaacgtgaccgttaacncccgttagttaccgtcgttacccgtttaccgttaccttacccgttacccgtacccttacgtacctaccgttaaccg

SEQ ID NO: 143410 - DNA, 839 bp, Homo sapiens
  misc_feature: GYAE6OF02G8RC8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtcgcctccatcagtagtggtttctcgtgggctgggtccgcagcctaccgaggggaacgggtctaggaactacgagttgggaacgttcggtacctcgtacgtagttaggttcgggtacggtttaccctaagtttaccgacggtttccggtccttacgtacgtaaacgggtacggttccggtaacggtacccgtaaccctaagtttaaccgtccgttaccggtacgggtaaccaccgtttaccggaacgtactaacgtacgttaccgtttttccccgaaggtaacgtacgtacgttacggttacgtcggtacggtacccggtccgtacgtaccggaacgtaccggggtttaccttttaattacggttacgggtcgtaccgggaaaggtacgggtaacggtaccgtttaacttaacggttcgtttaggtttttaccggggagggttttacggttaatttaccggtaaccctaaccgttaggtaccggtaccggggtacggggaccgttacccggtaaccgggtccggggtaccgtaacggttaacgtacccgggtttacgcccgttaaccgtccgttaccgttaccgtacccgtactaacccggaacgggtaccctcggttacccgtcccgttacccgtcgcccgtaccttaccggaccaggaccgtaacccgg

SEQ ID NO: 143411 - DNA, 626 bp, Homo sapiens
  misc_feature: GYAE6OF02FOY5C.46.67.G01.1.454.CMB.1.raw
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggacacagtcgtcaccatccacgttgccgggcaaggtcggaacnttgacaccttatttaaatgtatcaacatanaccagggaccgacccctaagcctcctaactctatgctgcatccagtttgacaaaggtcgggtacccagtcgaggttcagtgcagtgatcgtggacagtattcactcctacacctactcagttaactcgtcgactaacgtgtaaagttactttacggacttaaacgttacttaacgttcgtaacctaaacgtagtaaactttacgtaagtttcggtttaccggaacggtaacgggtaactaaaccgtaacttaaaactaaaacttaaaacgaacgttagtacggtacctcgtccgtaacccattcgtacgttccttaaccgtcgtttccccttacccggtaccctacgtttccgtagttaaccg

SEQ ID NO: 143412 - DNA, 471 bp, Homo sapiens
  misc_feature: GYAE6OF01A2BHW.15.38.D05.1.454.CMB.1.raw
  modified_base (451)..(451): a, c, t, g, unknown or other
  misc_feature (451)..(451): n is a, c, g, or t
  modified_base (457)..(471): a, c, t, g, unknown or other
  misc_feature (457)..(471): n is a, c, g, or t
tcagtctacgtagccacgaccggtgctcgatttagtatctgatagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtaacaaaaggggaggggacttactttgactacgtggggccgggaaccctggtcaccgtctcctcagcctccaccgaagggcccatcggtccttcccccgtggccacccctcctccaagacgcacctcgtggggcacagccgcctggctgcctggtcaaggacctactccgctacgtagactggagcgggctgggcaaggcncatagnnnnnnnnnnnnnnn

SEQ ID NO: 143413 - DNA, 631 bp, Homo sapiens
  misc_feature: GYAE6OF01BN0ET.15.38.D05.1.454.CMB.1.raw
  modified_base (551)..(551): a, c, t, g, unknown or other
  misc_feature (551)..(551): n is a, c, g, or t
  modified_base (602)..(631): a, c, t, g, unknown or other
  misc_feature (602)..(631): n is a, c, g, or t
tcagtctacgtagccacgaccggtgctcgatttagtatctgatagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagacgccgaggacacggctgtctattactgtgcgacgaaccgtagagagtagggtaacgaaaaggggaggggtactttacgttagaacttacggtcggggaccggggtaacccggtacggtaccgtacccgttaccgtcccttaccaccgcccttccccgaacccgaaccgggacccgtacccgttaccggttccccgtttcccccgtcccgggtaccctccccttacccctaccccgaacgtaaccgcctaacccgtccgtcggggtaccgaccgaacggcccggtcccggtcgggccgtcgccgttcggacgtaacggacgttaccctaccgtccgtacgtaggtacccnggaccgggtacgggtcacgggtaccggaagtcccggactactaagtgcgcnnnnnnnnnnnnnnnnnnnnnnnnnnnnnn

SEQ ID NO: 143414 - DNA, 448 bp, Homo sapiens
  misc_feature: GYAE6OF02GMQUX.15.38.D05.1.454.CMB.1.raw
  modified_base (445)..(448): a, c, t, g, unknown or other
  misc_feature (445)..(448): n is a, c, g, or t
tcagtctacgtagccacgaccggtgctcgatttagtatctgatagttgggtccgccaggctccagggaaggggctggagtgggtggtcaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtacaaaagggaggggacttactttgactactgggccggggaaccctggtcaccgtctcctcagcctcaccaagggcccatcggtcttccccctggcaccctcctccaagagcacctctggggcacagcggccctgggctgcctgtcaaggactacttccgctacgtagactgagcgggctggcaaggcgcatagnnnn

SEQ ID NO: 143415 - DNA, 546 bp, Homo sapiens
  misc_feature: GYAE6OF01EKEI7.44.72.G06.1.454.CMB.1.raw
  modified_base (238)..(238): a, c, t, g, unknown or other
  misc_feature (238)..(238): n is a, c, g, or t
  modified_base (516)..(516): a, c, t, g, unknown or other
  misc_feature (516)..(516): n is a, c, g, or t
  modified_base (519)..(546): a, c, t, g, unknown or other
  misc_feature (519)..(546): n is a, c, g, or t
tcagacagtatatacacgaccggtgctcgatttagctacgactgcaagggaaaggggctggagtgggtggccatcatgaagaaagatggaactgagacacactatgtggactctgtggaagggccattcaccatctccagagacaacgccaaagaacctcactgtatctgacaaatgaacagtctgagagtcgaggaccacggctgtgttattattggtggcgggaggcgcgtggggngctcattgaccttacgtggggtcgacgggaaccctggtccaccgtctcctcacgccctccaccgaacgggcccacgttccggtcccttcccccgtggcccgcccctcgcctccgagggacgcctacccgtccgagacgaccaccgacggccccggacccgtcgggcctacggcccgttagggtaccaaacgggtaccttaacctttccctaagttacttaccgttcggtcgtaggacgggtccggggtcgtcgggaccgacgggccgactaagtagcngtnnnnnnnnnnnnnnnnnnnnnnnnnnnn

SEQ ID NO: 143416 - DNA, 639 bp, Homo sapiens
  misc_feature: GYAE6OF01CVHJM.44.72.G06.1.454.CMB.1.raw
  modified_base (351)..(351): a, c, t, g, unknown or other
  misc_feature (351)..(351): n is a, c, g, or t
tcagacagtatatacacgaccggtgctcgatttagctacgactgcaaggggaaagggggcagacccactcaggacacagcatggacatgagggtccccgctcagctcctggggcttctgctgctctggctcccaggtgccagatgtgccatccacttgacccagtctccgtcctcactgtctgcgtctagttgggacagatcaccatcacttgccgggcgagtcgccgaatattaggtacttttttggcgttggtttcagcaggagcctggacaaacgcccctaagtccctgattcttttctggactcctactttagaaggtgtggacgtcccagccaggttcaggccggnaggtcggttcgtgggactactatttcactctacaccatcagcagcctgacacgaccgtggacgttacgtttaccgcgtaacttacttaccgtacgaccctaaattaacttacttttaccttttttacgtaacccgtttacgttacggttttacgggaccgtaacggggtaaccaacggtcgttaacgggaagtacgttaaaccgaaagggtaacgttacgggtacgggttactcgggacctaacccgtagtttaccgtcgttacctttactccgttcccttaccccgg

SEQ ID NO: 143417 - DNA, 417 bp, Homo sapiens
  misc_feature: GYAE6OF02F5WFX.44.72.G06.1.454.CMB.1.raw
  modified_base (411)..(417): a, c, t, g, unknown or other
  misc_feature (411)..(417): n is a, c, g, or t
tcagacagtatatacacgaccggtgctcgatttagctacgactgcaagggaaaggggctggagtgggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggtcaccgtctcctcagcctccaccaagggcccatcggtcttccccctggcgccctgctccaggagcacctccgagagcacagcggccctgggctgcctggtcaaggctacttccacgtctactgctgagcgggctggcaaggcgcatagnnnnnnn

SEQ ID NO: 143418 - DNA, 359 bp, Homo sapiens
  misc_feature: GYAE6OF01BONDH.37.17.B06.1.454.CMB.1.raw
  modified_base (352)..(359): a, c, t, g, unknown or other
  misc_feature (352)..(359): n is a, c, g, or t
tcagtagtgtagatcacgaccggtgctcgatttagtcgatagtgaagggccgcttcaccatctccagagactattccaagagtactctgtatctgcaaatgaacagcctgagtgccgaggacacggccctatattattgtgcgaaatgtggggagtggggctactcctggcgttttgactactggggccagggagccctggtcaccgtctccgtcagcctccaccaagggcccatcggtcttccccctggcgccctgctccaggagcacctccgagagcacagcggccctgggctgcctggtcaaggctacttccgatctacactactgagcgggctggcaaggcgcatagnnnnnnnn

SEQ ID NO: 143419 - DNA, 351 bp, Homo sapiens
  misc_feature: GYAE6OF01BR19A.37.17.B06.1.454.CMB.1.raw
  modified_base (349)..(351): a, c, t, g, unknown or other
  misc_feature (349)..(351): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggagtggggctactcctggcgtttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 143420 - DNA, 351 bp, Homo sapiens
  misc_feature: GYAE6OF01BESX0.37.17.B06.1.454.CMB.1.raw
  modified_base (349)..(351): a, c, t, g, unknown or other
  misc_feature (349)..(351): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtggggctactcctggcgtttgactactggggccagggagccctggtcaccgtctcctcagcctccaccaagggcccatcggtcttcccctggcgccctgctccaggagcacctccgagagcacagcgccctgggctgcctggtcaaggactacttccatctacactactgagcgggctggcaaggcgcatagnnn

SEQ ID NO: 143421 - DNA, 357 bp, Homo sapiens
  misc_feature: GYAE6OF01CUNIL.37.17.B06.1.454.CMB.1.raw
  modified_base (352)..(357): a, c, t, g, unknown or other
  misc_feature (352)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggccgccctgctccaggagcacctccgagagcacagcggccctgggctgcctggtcaaggctacttccatctacactactgagcgggctggcaaggcgcatagnnnnnn

SEQ ID NO: 143422 - DNA, 356 bp, Homo sapiens
  misc_feature: GYAE6OF01DHBJ7.37.17.B06.1.454.CMB.1.raw
  modified_base (351)..(356): a, c, t, g, unknown or other
  misc_feature (351)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgcccctgctccaggagcacctcgagagcacagcggccctgggctgcctggtcaaggctacttccatctacactactgagcgggctggcaaggcgcatagnnnnnn

SEQ ID NO: 143423 - DNA, 355 bp, Homo sapiens
  misc_feature: GYAE6OF01D6527.37.17.B06.1.454.CMB.1.raw
  modified_base (352)..(355): a, c, t, g, unknown or other
  misc_feature (352)..(355): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnn

SEQ ID NO: 143424 - DNA, 355 bp, Homo sapiens; identical to SEQ ID NO: 143423
  misc_feature: GYAE6OF01BDAU9.37.17.B06.1.454.CMB.1.raw
  modified_base (352)..(355): a, c, t, g, unknown or other
  misc_feature (352)..(355): n is a, c, g, or t

SEQ ID NO: 143425 - DNA, 357 bp, Homo sapiens
  misc_feature: GYAE6OF01ESX70.37.17.B06.1.454.CMB.1.raw
  modified_base (354)..(357): a, c, t, g, unknown or other
  misc_feature (354)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtggggcctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnn

SEQ ID NO: 143426 - DNA, 355 bp, Homo sapiens
  misc_feature: GYAE6OF01EH6U6.37.17.B06.1.454.CMB.1.raw
  modified_base (344)..(344): a, c, t, g, unknown or other
  misc_feature (344)..(344): n is a, c, g, or t
  modified_base (350)..(355): a, c, t, g, unknown or other
  misc_feature (350)..(355): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctctattactgtgcgagagatcagacggagtatagcagcagctctgactactggggccacggaaccctggtcaccgtctcctcagcctccaccaagggcccatcggtccttccccctggccaccctcctccaagagcacctcgtgggggcacagcggccctgggctgcctggtcaaggactacttccatctacactactgagcggctggcaaggcncatagnnnnnn

SEQ ID NO: 143427 - DNA, 356 bp, Homo sapiens
  misc_feature: GYAE6OF01BZ6OC.37.17.B06.1.454.CMB.1.raw
  modified_base (351)..(356): a, c, t, g, unknown or other
  misc_feature (351)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnn

SEQ ID NO: 143428 - DNA, 355 bp, Homo sapiens
  misc_feature: GYAE6OF01BMFD6.37.17.B06.1.454.CMB.1.raw
  modified_base (352)..(355): a, c, t, g, unknown or other
  misc_feature (352)..(355): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnn

SEQ ID NO: 143429 - DNA, 355 bp, Homo sapiens
  misc_feature: GYAE6OF01BCDTJ.37.17.B06.1.454.CMB.1.raw
  modified_base (353)..(355): a, c, t, g, unknown or other
  misc_feature (353)..(355): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnn

SEQ ID NO: 143430 - DNA, 357 bp, Homo sapiens
  misc_feature: GYAE6OF01CT22B.37.17.B06.1.454.CMB.1.raw
  modified_base (350)..(350): a, c, t, g, unknown or other
  misc_feature (350)..(350): n is a, c, g, or t
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcanagnnnnn

SEQ ID NO: 143431 - DNA, 356 bp, Homo sapiens
  misc_feature: GYAE6OF01AMQVY.37.17.B06.1.454.CMB.1.raw
  modified_base (351)..(356): a, c, t, g, unknown or other
  misc_feature (351)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaggactacttccatctacactactgagcgggctggcaaggcgcatagnnnnnn

SEQ ID NO: 143432 - DNA, 360 bp, Homo sapiens
  misc_feature: GYAE6OF01EZI9T.37.17.B06.1.454.CMB.1.raw
  modified_base (355)..(360): a, c, t, g, unknown or other
  misc_feature (355)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcaccctcctccaagagcacctctgggggcacagcggccctgggctgcctggtcaaggactacatccatctacactactggagcgggctggcaaggcgcatagnnnnnn

SEQ ID NO: 143433 - DNA, 364 bp, Homo sapiens
  misc_feature: GYAE6OF01CXMRU.37.17.B06.1.454.CMB.1.raw
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (359)..(364): a, c, t, g, unknown or other
  misc_feature (359)..(364): n is a, c, g, or t
tcagtagtgtagatcacgaccggtgctcgatttagtcgatagtgaagggccgcttcaccatctccagagactattccaagagcactttgtatctgcaaatgaacagcctgagtgccgaggacacggccctatattattgtgcgaaatggtggggggagtgggggctactcctggcgttttgactacgtggggccagggagccctggtcaccgtctcctcagcctccaccaagggcccatcggtccttccccnggccgccctgctccagganccacctccgagagcacagcggcctgggctgcctggtcaaggctacttccatctacactactgagcgggctggacaagggcacaatagnnnnnn

SEQ ID NO: 143434 - DNA, 355 bp, Homo sapiens; identical to SEQ ID NO: 143423
  misc_feature: GYAE6OF01EG5OC.37.17.B06.1.454.CMB.1.raw
  modified_base (352)..(355): a, c, t, g, unknown or other
  misc_feature (352)..(355): n is a, c, g, or t

SEQ ID NO: 143435 - DNA, 421 bp, Homo sapiens
  misc_feature: GYAE6OF01C8LC2.37.17.B06.1.454.CMB.1.raw
  modified_base (379)..(421): a, c, t, g, unknown or other
  misc_feature (379)..(421): n is a, c, g, or t
tcagtagtgtagatcacgaccggtgctcgatttagtcgatagtgaaggggccgcttcaccatcttccacgagactattccaagagccactctgtatcttgcaaatgaacagcctgagtgcccgaggacacggccctatattattagtgcgaaatgtggggggagtgggggctactcctggccgtttttgactactggggccagggaggaccctggtccacccgtctccctcagcctccaccaagggcccatcggtcttccccctggtcgccctgctccaggagaccaccgtccgagacgccacagccggccctgggcttgccgtggtcaaggcctacttccatctacactactgacgcgggctggcaaggcgcagtagnnnnnnnnnnnnnnnnnnnnnnnnnnnnnnnnnnnnnnnnnnn

SEQ ID NO: 143436 - DNA, 356 bp, Homo sapiens
  misc_feature: GYAE6OF01B2T7V.37.17.B06.1.454.CMB.1.raw
  modified_base (353)..(356): a, c, t, g, unknown or other
  misc_feature (353)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnn

SEQ ID NO: 143437 - DNA, 366 bp, Homo sapiens
  misc_feature: GYAE6OF01AQL05.37.17.B06.1.454.CMB.1.raw
  modified_base (364)..(366): a, c, t, g, unknown or other
  misc_feature (364)..(366): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaagtggtgggggagtggggctactcctggcgttttgactacgtggggccagggagccctggtccaccgtctcctcacgccctccaccaagggcccatccggtccttcccccgtggccgccctgctccgaggacgccacctccgagagccacagcggccctgggctgcctggtcaagctacttccatctacactactgagcgggctggcaaggcgcatagnnn

SEQ ID NO: 143438 - DNA, 571 bp, Homo sapiens
  misc_feature: GYAE6OF01ACRED.37.17.B06.1.454.CMB.1.raw
  modified_base (216)..(216): a, c, t, g, unknown or other
  misc_feature (216)..(216): n is a, c, g, or t
  modified_base (457)..(457): a, c, t, g, unknown or other
  misc_feature (457)..(457): n is a, c, g, or t
  modified_base (462)..(463): a, c, t, g, unknown or other
  misc_feature (462)..(463): n is a, c, g, or t
  modified_base (465)..(467): a, c, t, g, unknown or other
  misc_feature (465)..(467): n is a, c, g, or t
  modified_base (471)..(471): a, c, t, g, unknown or other
  misc_feature (471)..(471): n is a, c, g, or t
  modified_base (475)..(476): a, c, t, g, unknown or other
  misc_feature (475)..(476): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (565)..(566): a, c, t, g, unknown or other
  misc_feature (565)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
tcagtagtgtagatcacgaccggtgctcgatttagtcgatagtgaagggtccggtcggttcaccatcctccagagactattcaagagcgactctgtagtcctgcaaatgaacaggcctcgagtcgccgaggacacgggccctactagttacttgtgcgaaatgtggggggacgtgggggctacctctggtcgttttgacctctggggccagggacnccttggtcaccggtctcctcgacgcctaccaccaacgggccctagtccgggtccttcccccgtggccggccccttgcctaccgagggtacgtcctaccgtccggaggtcgccacgacggccgggacccgtgggggcctcggccccttgggtacaacggtaccttacttccgaattccgtaacaccttacgtcggaacggtcggggtctacgggaccgtaacgggcccgactacgtacggtncgcgnngnnngcgngacnnctcnctctcacncncncncncncncncncncgngntntnatntntcntnatatntactctctcgcgcgcgcgngngngcgagacgacanncngnc

SEQ ID NO: 143439 - DNA, 357 bp, Homo sapiens
  misc_feature: GYAE6OF01CQGO6.37.17.B06.1.454.CMB.1.raw
  modified_base (351)..(357): a, c, t, g, unknown or other
  misc_feature (351)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactactccatctacactactgagcgggctggcaaggcgcatagnnnnnnn

SEQ ID NO: 143440 - DNA, 358 bp, Homo sapiens
  misc_feature: GYAE6OF01BZRJ8.37.17.B06.1.454.CMB.1.raw
  modified_base (354)..(358): a, c, t, g, unknown or other
  misc_feature (354)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnn

SEQ ID NO: 143441 - DNA, 360 bp, Homo sapiens
  misc_feature: GYAE6OF01AKI2K.37.17.B06.1.454.CMB.1.raw
  modified_base (355)..(360): a, c, t, g, unknown or other
  misc_feature (355)..(360): n is a, c, g, or t
tcagtagtgtagatcacgaccggtgctcgatttagtcgatagtgaagggccgcttcaccatctccagagactattccaagagcactctgtatctgcaaatgaacagcctgagtggccgaggacaacggccctatattattgtgcgaaatgtgggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnn

SEQ ID NO: 143442 - DNA, 453 bp, Homo sapiens
  misc_feature: GYAE6OF01DD8CJ.37.17.B06.1.454.CMB.1.raw
  modified_base (440)..(453): a, c, t, g, unknown or other
  misc_feature (440)..(453): n is a, c, g, or t
tcagtagtgtagatcacgaccggtgctcgatttagtcgatagtgaagggccggcttcaccatctccagagactattccaagagcactctgtatctgcaaatgaacagcctgagtgccgaggacacggccctatattattgtgcgaaatggtggggggagtgggggctactcctggcgttttgactacgtggggccagggagccctggtcaccgtctcctcagcctccaccaaacgggcccaagtccgggtccttccccccgtgggccgtccccgttggccttacccgaagggtacggcctaacccgttcccggaagaaggccaaccaacggccgggccccctagggggccttacggccccttggtaccaaagggaccttacgttcccaattccttaacaccttaacctggaaggcgggctgggcaaagggcgacataggnnnnnnnnnnnnnn

SEQ ID NO: 143443 - DNA, 358 bp, Homo sapiens
  misc_feature: GYAE6OF01AR258.37.17.B06.1.454.CMB.1.raw
  modified_base (355)..(358): a, c, t, g, unknown or other
  misc_feature (355)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttccccctggcgccctgctccaggagcacctccgagagcacagcggccctgggctgcctggtcaaggactacttccatctacactactgagcgggctggcaaggcgcatagnnnn

SEQ ID NO: 143444 - DNA, 357 bp, Homo sapiens
  misc_feature: GYAE6OF01AM8RS.37.17.B06.1.454.CMB.1.raw
  modified_base (352)..(357): a, c, t, g, unknown or other
  misc_feature (352)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnn

SEQ ID NO: 143445 - DNA, 359 bp, Homo sapiens
  misc_feature: GYAE6OF01DMV3J.37.17.B06.1.454.CMB.1.raw
  modified_base (354)..(359): a, c, t, g, unknown or other
  misc_feature (354)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnn

SEQ ID NO: 143446 - DNA, 400 bp, Homo sapiens
  misc_feature: GYAE6OF01C0E9V.37.17.B06.1.454.CMB.1.raw
  modified_base (363)..(363): a, c, t, g, unknown or other
  misc_feature (363)..(363): n is a, c, g, or t
  modified_base (368)..(378): a, c, t, g, unknown or other
  misc_feature (368)..(378): n is a, c, g, or t
  modified_base (380)..(380): a, c, t, g, unknown or other
  misc_feature (380)..(380): n is a, c, g, or t
  modified_base (382)..(400): a, c, t, g, unknown or other
  misc_feature (382)..(400): n is a, c, g, or t
tcagtagtgtagatcacgaccggtgctcgatttagtcgatagtgaagggccgcttcaccagtctccagagactattccaagagcactctgtatctgcaaatgaacagcctgagtgccgaggacacggcctatattattgtgcgaaatgtggggggagttgggggctactccttggcgttttgactactgggggccaggggagccctggtcaccggtctcctcaggcctccaccaagggcccatcggtcttccccctggcgcccctgcctccaggacgccacctccgagagtccacagcggccctgggctgcctggtcaaggctacttccatctacacgtacgtgaggcgggctggccaaggcnatagnnnnnnnnnnngngnnnnnnnnnnnnnnnnnnn

SEQ ID NO: 143447 - DNA, 358 bp, Homo sapiens; identical to SEQ ID NO: 143440
  misc_feature: GYAE6OF01AQN0R.37.17.B06.1.454.CMB.1.raw
  modified_base (354)..(358): a, c, t, g, unknown or other
  misc_feature (354)..(358): n is a, c, g, or t

SEQ ID NO: 143448 - DNA, 358 bp, Homo sapiens
  misc_feature: GYAE6OF01EBZD0.37.17.B06.1.454.CMB.1.raw
  modified_base (352)..(358): a, c, t, g, unknown or other
  misc_feature (352)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnnn

SEQ ID NO: 143449 - DNA, 376 bp, Homo sapiens
  misc_feature: GYAE6OF01BNV2L.37.17.B06.1.454.CMB.1.raw
  modified_base (367)..(376): a, c, t, g, unknown or other
  misc_feature (367)..(376): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccagggagccctggtcaccgtctcctcagcctccaccaagggcccatccggtccttcccctggccgccctgcctccaggagccacctccgagagccacagccggccctggggctgcctggtcaaggacctacttccatccacactactgagcgggctgggacaaggcgacatagnnnnnnnnnn

SEQ ID NO: 143450 - DNA, 376 bp, Homo sapiens
  misc_feature: GYAE6OF01CTX34.37.17.B06.1.454.CMB.1.raw
  modified_base (370)..(376): a, c, t, g, unknown or other
  misc_feature (370)..(376): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccagggagccctggtccaccgtctcctcagcctccaaccaacgggcccatccggtccttcccctggccgccctgcctccgaggacgccaccgtccgagacgcacagccggccctgggctgcctggtcaaggactactccatctacactactgagcgggctggacaaggcgcaagtagnnnnnnn

SEQ ID NO: 143451 - DNA, 358 bp, Homo sapiens; identical to SEQ ID NO: 143440
  misc_feature: GYAE6OF01AYTSQ.37.17.B06.1.454.CMB.1.raw
  modified_base (354)..(358): a, c, t, g, unknown or other
  misc_feature (354)..(358): n is a, c, g, or t

SEQ ID NO: 143452 - DNA, 494 bp, Homo sapiens
  misc_feature: GYAE6OF01A8OXB.37.17.B06.1.454.CMB.1.raw
  modified_base (480)..(480): a, c, t, g, unknown or other
  misc_feature (480)..(480): n is a, c, g, or t
  modified_base (483)..(494): a, c, t, g, unknown or other
  misc_feature (483)..(494): n is a, c, g, or t
tcagtagtgtagatcacgaccggtgctcgatttagtcgatagtgaagggccgcttcaccatctccagagactattccaagagcactctgtatctgacaaatgaacagcctgagtgccgagacacggcctatattattgtgacgaagtgggtgggggagtcggggtctactcgtggtcgtttagacgtacggtcgggccgagggtaccgtcccgttcggtccctacccgttcctcccgtaccgaccgtccccgtacccgaacccggtaaccgggtccccttaccggttccccggttccccgttccccggcggtcccgtcccgtcgcccgtaccggacggtacccgacccgtaccggacggacgaccgaccgaccggccggtccggtccggtcgtccgtacggtacgtacgtaccgtaccgttaccttacctactacgtaccgtacgtacgtcggacggtacggcggtacgacggacgacgnagnnnnnnnnnnnn

SEQ ID NO: 143453 - DNA, 358 bp, Homo sapiens
  misc_feature: GYAE6OF01A3V0P.37.17.B06.1.454.CMB.1.raw
  modified_base (353)..(358): a, c, t, g, unknown or other
  misc_feature (353)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnn

SEQ ID NO: 143454 - DNA, 360 bp, Homo sapiens
  misc_feature: GYAE6OF01DCZGA.37.17.B06.1.454.CMB.1.raw
  modified_base (338)..(338): a, c, t, g, unknown or other
  misc_feature (338)..(338): n is a, c, g, or t
  modified_base (354)..(360): a, c, t, g, unknown or other
  misc_feature (354)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagccggccctgggctgcctggtcaaggactacttccatctacactactgagcgggntggcaaggcgcatagnnnnnnn

SEQ ID NO: 143455 - DNA, 357 bp, Homo sapiens
  misc_feature: GYAE6OF01DPXSB.37.17.B06.1.454.CMB.1.raw
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgcctccaggagcacctccgagagcacagcggccctgggctgcctggtcaaggctactccatctacactactgagcgggctggcaaggcgcatagnnnnn

SEQ ID NO: 143456 - DNA, 358 bp, Homo sapiens
  misc_feature: GYAE6OF01BUZUN.37.17.B06.1.454.CMB.1.raw
  modified_base (348)..(348): a, c, t, g, unknown or other
  misc_feature (348)..(348): n is a, c, g, or t
  modified_base (354)..(358): a, c, t, g, unknown or other
  misc_feature (354)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgcggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcncatagnnnnn

SEQ ID NO: 143457 - DNA, 359 bp, Homo sapiens
  misc_feature: GYAE6OF01ACSHV.37.17.B06.1.454.CMB.1.raw
  modified_base (352)..(359): a, c, t, g, unknown or other
  misc_feature (352)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnnnn

SEQ ID NO: 143458 - DNA, 356 bp, Homo sapiens
  misc_feature: GYAE6OF01CONZM.37.17.B06.1.454.CMB.1.raw
  modified_base (353)..(356): a, c, t, g, unknown or other
  misc_feature (353)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccattacactactgagcgggctggcaaggcgcatagnnnn

SEQ ID NO: 143459 - DNA, 441 bp, Homo sapiens
  misc_feature: GYAE6OF01CW3IV.37.17.B06.1.454.CMB.1.raw
  modified_base (370)..(370): a, c, t, g, unknown or other
  misc_feature (370)..(370): n is a, c, g, or t
  modified_base (391)..(393): a, c, t, g, unknown or other
  misc_feature (391)..(393): n is a, c, g, or t
  modified_base (395)..(396): a, c, t, g, unknown or other
  misc_feature (395)..(396): n is a, c, g, or t
  modified_base (398)..(441): a, c, t, g, unknown or other
  misc_feature (398)..(441): n is a, c, g, or t
tcagtagtgtagatcacgaccggtgctcgatttagtcgatagtgaagggccgctttctaccggatcgtccagagacctattccaagagcactctgtatctgcaaagtcgaacagcctgacgtggcccgaggacacggccctatattattcgtgcgaaatgtggggggagtgggggctactcctggcgttttgacctactggggcccagggcgccctggtcaccggtctcctcagcctccaccaagggcccatcggtcttcccctggcgccctgctccgaggagcacctccgagagccacagccggccctggggacctaggcccgtagggtccaaaggacctacgttcccattctacactactgagcgggntgggactagggccgcataggnnngnngnnnnnnnnnnnnnnnnnnnnnnnnnnnnnnnnnnnnnnnnnnnn

SEQ ID NO: 143460 - DNA, 358 bp, Homo sapiens
  misc_feature: GYAE6OF01CE8VY.37.17.B06.1.454.CMB.1.raw
  modified_base (353)..(358): a, c, t, g, unknown or other
  misc_feature (353)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnn

SEQ ID NO: 143461 - DNA, 357 bp, Homo sapiens
  misc_feature: GYAE6OF01BV93N.37.17.B06.1.454.CMB.1.raw
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccacggaaccctggtcaccgtctcctcagcctccgccaagggcccatcggtcttcccctggcaccctcctccaagagcacctctgggggcacagcggccctgggctgcctggtcaaggactacttccatctacactactgagcgggctggcaaggcgcatagnnnnn

SEQ ID NO: 143462 - DNA, 357 bp, Homo sapiens
  misc_feature: GYAE6OF01DIW0F.37.17.B06.1.454.CMB.1.raw
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggagtgggggctactcctggcgttttgactactggggccagggagccctggtcaccgtctcctcagcctccaccaagggcccatcggtcttcccctggcgccctgctccaggagcacctcgagagcacagccggcctgggctgcctggtcaaggctacttccatctaacactactgacgcgggctggcaaggcgcatagnnnnn

SEQ ID NO: 143463 - DNA, 358 bp, Homo sapiens
  misc_feature: GYAE6OF01C6XBL.37.17.B06.1.454.CMB.1.raw
  modified_base (355)..(358): a, c, t, g, unknown or other
  misc_feature (355)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagccggccctgggctgcctggtcaaggactacttccatctacactactgagcgggctggcaaggcgcatagnnnn

SEQ ID NO: 143464 - DNA, 360 bp, Homo sapiens
  misc_feature: GYAE6OF01BQEVW.37.17.B06.1.454.CMB.1.raw
  modified_base (351)..(351): a, c, t, g, unknown or other
  misc_feature (351)..(351): n is a, c, g, or t
  modified_base (357)..(360): a, c, t, g, unknown or other
  misc_feature (357)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttccccctggccgccctgctccaggagccacctccgagagcacagcggccctgggctgcctggtcaaggactacttccatctacactactgagcgggctggcaaggcncatagnnnn

SEQ ID NO: 143465 - DNA, 400 bp, Homo sapiens
  misc_feature: GYAE6OF01EJM6X.37.17.B06.1.454.CMB.1.raw
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
  modified_base (364)..(400): a, c, t, g, unknown or other
  misc_feature (364)..(400): n is a, c, g, or t
tcagtagtgtagatcacgaccggtgctcgatttagtcgatagtgaagggccggtcgttcaccatctccagagacctattccaagagcactcctgtatctgcaaatgaacagcctgagtgccgaggaccacggccctatattattgtagcgaaatgtggggggagtgggggctactcctggcgttttgactactggggccagggagcccgtggtcaccgtctcctcagcctccaccaagggcccatcggtcttccccngcgccctgctccaggancacctccgagagcacagccggcctgggctgctggtcaagggctacttccatcctacactactgacgccgggctggacaaggcgcataggnnnnnnnnnnnnnnnnnnnnnnnnnnnnnnnnnnnnn

SEQ ID NO: 143466 - DNA, 376 bp, Homo sapiens
  misc_feature: GYAE6OF01BP1GF.37.17.B06.1.454.CMB.1.raw
  modified_base (253)..(253): a, c, t, g, unknown or other
  misc_feature (253)..(253): n is a, c, g, or t
  modified_base (358)..(376): a, c, t, g, unknown or other
  misc_feature (358)..(376): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactcctggcgttttgactacgtggggccagggagccctggtcaccgtctcctcagcctccaccaagggcccatcggtccttccccnggccgccctgctccaggacgcacctccgagagcacagcggccctgggctgcctggtcaaggactacttcatctacactactgagcgggctggcaaggcacatagnnnnnnnnnnnnnnnnnnn

SEQ ID NO: 143467 - DNA, 358 bp, Homo sapiens; identical to SEQ ID NO: 143453
  misc_feature: GYAE6OF01CENA9.37.17.B06.1.454.CMB.1.raw
  modified_base (353)..(358): a, c, t, g, unknown or other
  misc_feature (353)..(358): n is a, c, g, or t

SEQ ID NO: 143468 - DNA, 386 bp, Homo sapiens
  misc_feature: GYAE6OF01BVJDF.37.17.B06.1.454.CMB.1.raw
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (370)..(386): a, c, t, g, unknown or other
  misc_feature (370)..(386): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactacgtggggccagggagccctggtccaccgtctcctcacgcctccaccaagggcccatccggtccttcccccgtggccgccctgcctccaggagccacctccgagagccacacgccggccctgggctgcctggtcaaggcctacttccatcacnctactgagcgggctggaccaaggcncagtagngnnnnnnnnnnnnnnnnn

SEQ ID NO: 143469 - DNA, 355 bp, Homo sapiens
  misc_feature: GYAE6OF01D8G77.37.17.B06.1.454.CMB.1.raw
  modified_base (352)..(355): a, c, t, g, unknown or other
  misc_feature (352)..(355): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactactccatctacactactgagcgggctggcaaggcgcatagnnnn

SEQ ID NO: 143470 - DNA, 370 bp, Homo sapiens
  misc_feature: GYAE6OF01EBF1A.37.17.B06.1.454.CMB.1.raw
  modified_base (363)..(370): a, c, t, g, unknown or other
  misc_feature (363)..(370): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggccccatccggtccttccccctggccgccctgcctccaggacgcacctccgagagcacagccggccctgggctgcctggtcaaggacctacttccatctacactactgagcgggctggcaaggcgcatagnnnnnnnn

SEQ ID NO: 143471 - DNA, 358 bp, Homo sapiens
  misc_feature: GYAE6OF01BMD4F.37.17.B06.1.454.CMB.1.raw
  modified_base (356)..(358): a, c, t, g, unknown or other
  misc_feature (356)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttccccctggccgccctgctccaggagcacctccgagagcacagcggccctgggctgcctggtcaaggactacttccatctacactactgagcgggctggcaaggcgcatagnnn

SEQ ID NO: 143472 - DNA, 398 bp, Homo sapiens
  misc_feature: GYAE6OF01B1URZ.37.17.B06.1.454.CMB.1.raw
  modified_base (388)..(398): a, c, t, g, unknown or other
  misc_feature (388)..(398): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggcctatattattgtgcgaaatggtggggggagtgggggctactcctggcgttttgactacgtggggccagggagccctggtccaccgtctcctcacgccctccaaccgaacgggccccagttccggtccttcccccgtggccgccctgcctccgaggacgccacctccgagacgcacaggccggcccgtgggctcgcctggtacaaaggcctacttccatcctaacactacgtggacgcgggctgggacaaggcgacagtagnnnnnnnnnnn

SEQ ID NO: 143473 - DNA, 474 bp, Homo sapiens
  misc_feature: GYAE6OF01AD6WY.37.17.B06.1.454.CMB.1.raw
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (423)..(474): a, c, t, g, unknown or other
  misc_feature (423)..(474): n is a, c, g, or t
tcagtagtgtagatcacgaccggtgctcgatttagtcgatagtgaagggggccgcttcacccatctccagagactattccaagagcactctgtatctgcaaatgaacagcctgagtgccgaggtacacggccctatattatttgtgcgaaatggtgggggggagtgggggctactcctggcgttttgactacgtgggggccaggggagcccgtgggtcaccggttctcctcagccctccgaccaaggggcccatccggtccttccccctgggccgccctgctccaggacgcacctccgagacgcacaggccgggcccctgggggcctggccctgggtaccaaggggaccttacttccagtcctacgacttacttggacggtcggggctgggaccaaggccgactactaggcncncgngacnannnnnnnnnnnnnnnnnnnnnnnnnnnnnnnnnnnnnnnnnnnnnnnnnnnn

SEQ ID NO: 143474 - DNA, 367 bp, Homo sapiens
  misc_feature: GYAE6OF01BDFZK.37.17.B06.1.454.CMB.1.raw
  modified_base (351)..(351): a, c, t, g, unknown or other
  misc_feature (351)..(351): n is a, c, g, or t
  modified_base (357)..(367): a, c, t, g, unknown or other
  misc_feature (357)..(367): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgtttgactactggggccagggagccctggtcaccgtctcctcagcctccaccaagggcccatcggtcttccccctggcgccctgctccaggagcacctccgagagcacagcggccctgggctgcctggtccaaggacctacttccatcctacactactgagcgggctggcaaggcncatagnnnnnnnnnnn

SEQ ID NO: 143475 - DNA, 382 bp, Homo sapiens
  misc_feature: GYAE6OF01EEGLA.37.17.B06.1.454.CMB.1.raw
  modified_base (375)..(382): a, c, t, g, unknown or other
  misc_feature (375)..(382): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagccctccaccaagggcccatccggtccttcccccgtggccgccctgcctccgaggacgccaccgtccgagacgcacaggccggcccgtggggcctggcctgggtacaaggccttacttccatctacactactgagcgggctggcaaggcgcatagnnnnnnnn

SEQ ID NO: 143476 - DNA, 470 bp, Homo sapiens
  misc_feature: GYAE6OF01A0E24.37.17.B06.1.454.CMB.1.raw
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
  modified_base (417)..(419): a, c, t, g, unknown or other
  misc_feature (417)..(419): n is a, c, g, or t
  modified_base (421)..(470): a, c, t, g, unknown or other
  misc_feature (421)..(470): n is a, c, g, or t
tcagtagtgtagatcacgaccggtgctcgatttagtcgatagtgaagggccggcgttcaccatctccagagactattccaagagccactctgtatctgcaaatgaacagcctgagtgccgaggacacggtccctatattattgtgtcgaaatggtggggggagttgggggctactcctggcgtttttgactacgtggggccagggngccctggtccaccggtctcctnagccctccaccgaacggggccccatccggtccttccccctggcgccctgctccaggagccacctcgagacgccgaacacggcggtccccgttggggccttggacccctggggtacaaacgggtacctaacgtttcccaattcgtaaccacgtacctggaagccggggactgggaccaagggcacatagnnntnnnnnnnnnnnnnnnnnnnnnnnnnnnnnnnnnnnnnnnnnnnnnnnnnn

SEQ ID NO: 143477 - DNA, 356 bp, Homo sapiens
  misc_feature: GYAE6OF01D4CUX.37.17.B06.1.454.CMB.1.raw
  modified_base (353)..(356): a, c, t, g, unknown or other
  misc_feature (353)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatccggtcttcccctggccgccctgctccaggagcacctccgagagcacagcggcctgggctgcctggtcaaggctacttccatctacactactgagcgggctggcaaggcgcatagnnnn

SEQ ID NO: 143478 - DNA, 356 bp, Homo sapiens
  misc_feature: GYAE6OF01DRL3S.37.17.B06.1.454.CMB.1.raw
  modified_base (351)..(356): a, c, t, g, unknown or other
  misc_feature (351)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggccgccctgctccaggagcacctccgagagcacagcggcctgggctgcctggtcaaggactacttctctacactactgagcggctggcaaggcgcatagnnnnnn

SEQ ID NO: 143479 - DNA, 364 bp, Homo sapiens
  misc_feature: GYAE6OF01DX3IA.37.17.B06.1.454.CMB.1.raw
  modified_base (352)..(352): a, c, t, g, unknown or other
  misc_feature (352)..(352): n is a, c, g, or t
  modified_base (358)..(364): a, c, t, g, unknown or other
  misc_feature (358)..(364): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatccggtccttcccctggccgccctgctccaggagccacctccgagagcacaggcggccctgggctgccgtggtcaaggactactccatctacactactgagcgggctggcaaggcncatagnnnnnnn

SEQ ID NO: 143480 - DNA, 364 bp, Homo sapiens
  misc_feature: GYAE6OF01C759K.37.17.B06.1.454.CMB.1.raw
  modified_base (334)..(334): a, c, t, g, unknown or other
  misc_feature (334)..(334): n is a, c, g, or t
  modified_base (358)..(364): a, c, t, g, unknown or other
  misc_feature (358)..(364): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactactggggccagggacgccctggtcaccgtctcctcagcctccaccaagggcccatccggtccttccccctggccgcccctgcctccaggagccacctccgagagcacagcggccctgggctgcctgtcaagactactcatcacactacngagcggctggcaaggcgcagtagnnnnnnn

SEQ ID NO: 143481 - DNA, 360 bp, Homo sapiens
  misc_feature: GYAE6OF01DHF58.37.17.B06.1.454.CMB.1.raw
  modified_base (353)..(360): a, c, t, g, unknown or other
  misc_feature (353)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggcctgggctgcctggtcaaggactacttccatctacactactgagcgggctggcaaggcgcatagnnnnnnnn

SEQ ID NO: 143482 - DNA, 357 bp, Homo sapiens
  misc_feature: GYAE6OF01AS1YH.37.17.B06.1.454.CMB.1.raw
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnn

SEQ ID NO: 143483 - DNA, 393 bp, Homo sapiens
  misc_feature: GYAE6OF01EY6PV.37.17.B06.1.454.CMB.1.raw
  modified_base (309)..(309): a, c, t, g, unknown or other
  misc_feature (309)..(309): n is a, c, g, or t
  modified_base (376)..(393): a, c, t, g, unknown or other
  misc_feature (376)..(393): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggcccatccggtcttccccctggcccgcctcgctccacggagccaccctcccgacgagcacacgccggcccctcgggnccgtcgccgctggtccaacggacctacttccatctacactactgagcgggctggcaaggcgcatagnnnnnnnnnnnnnnnnnn

SEQ ID NO: 143484 - DNA, 372 bp, Homo sapiens
  misc_feature: GYAE6OF01DGA3B.37.17.B06.1.454.CMB.1.raw
  modified_base (350)..(350): a, c, t, g, unknown or other
  misc_feature (350)..(350): n is a, c, g, or t
  modified_base (356)..(372): a, c, t, g, unknown or other
  misc_feature (356)..(372): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacgagcggcccctgggcctgcctggtcaaggctactccatcctacactactgagcggctggccaaggcncatagnnnnnnnnnnnnnnnnn

SEQ ID NO: 143485 - DNA, 392 bp, Homo sapiens
  misc_feature: GYAE6OF01AMM4S.37.17.B06.1.454.CMB.1.raw
  modified_base (201)..(201): a, c, t, g, unknown or other
  misc_feature (201)..(201): n is a, c, g, or t
  modified_base (341)..(341): a, c, t, g, unknown or other
  misc_feature (341)..(341): n is a, c, g, or t
  modified_base (365)..(392): a, c, t, g, unknown or other
  misc_feature (365)..(392): n is a, c, g, or t
tcagtagtgtagatcacgaccggtgctcgatttagtcgatagtgaagggccgacgttcaccatctccagagactattccaagagcactcctgtatctgcaaatgaacagcctgagtgccgaggacacggccctatattattgtgcgaaatgtggggggagtgggggctactcctggtcgttttgactactggggccagggngccctggtcaccgtctcctcgagcctccaccaagggcccatcggtcttccccctggccgccctgctccaggagcacctccgagagccacagcggccctggggctcgcctggtacaaggactacgttccatctacactacngagcgggctggcaaggcgcatagnnnnnnnnnnnnnnnnnnnnnnnnnnnn

SEQ ID NO: 143486 - DNA, 363 bp, Homo sapiens
  misc_feature: GYAE6OF01CJJG6.37.17.B06.1.454.CMB.1.raw
  modified_base (348)..(348): a, c, t, g, unknown or other
  misc_feature (348)..(348): n is a, c, g, or t
  modified_base (354)..(363): a, c, t, g, unknown or other
  misc_feature (354)..(363): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctcgagagcacagcggccctgggctgcctggtcaaggacctacttccatctacactactgagcgggctggcaaggcncatagnnnnnnnnnn

SEQ ID NO: 143487 - DNA, 364 bp, Homo sapiens
  misc_feature: GYAE6OF01A2842.37.17.B06.1.454.CMB.1.raw
  modified_base (357)..(364): a, c, t, g, unknown or other
  misc_feature (357)..(364): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatccggtcttccccctggccgccctgctccaggagcacctccgagagcacagccggccctgggctgcctggtcaaggactacttccatctacactactgagcgggctggcaaggcgcatagnnnnnnnn

SEQ ID NO: 143488 - DNA, 390 bp, Homo sapiens
  misc_feature: GYAE6OF01B2P7M.37.17.B06.1.454.CMB.1.raw
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (380)..(390): a, c, t, g, unknown or other
  misc_feature (380)..(390): n is a, c, g, or t
tcagtagtgtagatcacgaccggtgctcgatttagtcgatagtgaagggccgcttcaccatctccagagactattccaagagcactctgtatctgacaaatgaacagcctgagtgccgaggacacggccctatattatgtgcgaaatggtggggggagtgggggctactcctggtcgttttgactacgtggggccagggacgcccgtggtcaccgtctcctcacgcctccaccgaagggcccatccggtccttccccgtggccgccctgcctccgaggacgcacctcgagacgcacgacggccggtcccgtgggctcgccgtggtacaagtacctactccatctacactacgngacgcgggctggacaaggcganagtgnnnnnnnnnnn

SEQ ID NO: 143489 - DNA, 367 bp, Homo sapiens
  misc_feature: GYAE6OF01BF6G1.37.17.B06.1.454.CMB.1.raw
  modified_base (357)..(367): a, c, t, g, unknown or other
  misc_feature (357)..(367): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttccccctggccgccctgcctccaggagccacctccgagagcacagcggccctgggctgcctggtcaaggctacttcatctacactactgacgcgggctggcaaggcgcatagnnnnnnnnnnn

SEQ ID NO: 143490 - DNA, 359 bp, Homo sapiens
  misc_feature: GYAE6OF01DFUSR.37.17.B06.1.454.CMB.1.raw
  modified_base (354)..(359): a, c, t, g, unknown or other
  misc_feature (354)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatccggtcttccccctggccgccctgctccaggagcacctcgagagcacagcggcctgggctgcctggtcaaggactacttccatctacactactgagcgggctggcaaggcgcatagnnnnnn

SEQ ID NO: 143491 - DNA, 360 bp, Homo sapiens
  misc_feature: GYAE6OF01EAGQX.37.17.B06.1.454.CMB.1.raw
  modified_base (353)..(360): a, c, t, g, unknown or other
  misc_feature (353)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagccacctccgagagcacagccggcctgggctgcctggtcaaggctacttccatctacactactgagcgggctggcaacggcgcatgnnnnnnnn

SEQ ID NO: 143492 - DNA, 358 bp, Homo sapiens
  misc_feature: GYAE6OF01EFT6Q.37.17.B06.1.454.CMB.1.raw
  modified_base (198)..(198): a, c, t, g, unknown or other
  misc_feature (198)..(198): n is a, c, g, or t
  modified_base (352)..(358): a, c, t, g, unknown or other
  misc_feature (352)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccaggganccctggtcaccgtctcctcagcctccaccaagggcccatcggtccttcccctggcgccctgctccaggagcacctccgagagcacagcggccctgggctgcctggtcaaggctactccatctacactactgagcgggctggcaaggcacatagnnnnnnn

SEQ ID NO: 143493 - DNA, 380 bp, Homo sapiens
  misc_feature: GYAE6OF01DXDH6.37.17.B06.1.454.CMB.1.raw
  modified_base (368)..(380): a, c, t, g, unknown or other
  misc_feature (368)..(380): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccagggagccctggtcaccgtctcctcagcctccaccgaagggcccatcggtccttcccctggccgccctgctccaggacgccacctccgagagcacagccgcccgtgggctcgccgtggtacaaggactacttccatctacactactgagcgggctggacaaggcgacagtagnnnnnnnnnnnnn

SEQ ID NO: 143494 - DNA, 368 bp, Homo sapiens
  misc_feature: GYAE6OF01CYWPA.37.17.B06.1.454.CMB.1.raw
  modified_base (362)..(368): a, c, t, g, unknown or other
  misc_feature (362)..(368): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggcccatcggtccttccccctggccgccctgcctccaggacgccacctccgagagccacagccggccctgggctgcctggtcaaggctactccatctacactactgagcgggctggacaaggcgcagtagnnnnnnn

SEQ ID NO: 143495 - DNA, 381 bp, Homo sapiens
  misc_feature: GYAE6OF01DQRY6.37.17.B06.1.454.CMB.1.raw
  modified_base (373)..(381): a, c, t, g, unknown or other
  misc_feature (373)..(381): n is a, c, g, or t
tcagtagtgtagatcacgaccggtgctcgatttagtcgatagtgaagggccgcttcaccatctccagagactattccaagagcactctgtatctgacaaatgaacagcctgagtgccgaggacacggcctatattattgtgcgaaatggtggggggagtgggggctactcctggcgttttgactacgtggggccagggagccctggtcaccgtctcctcagcctaccaccgaagggcccctatccggtccttccccctgggccgccctgcctccaggacgccacctccgagagcacagccggccctgggctcgcctggtcaaggacctacttccatcaacactactgacgcgggctgggcaaggcgacatagnnnnnnnnn

SEQ ID NO: 143496 - DNA, 372 bp, Homo sapiens
  misc_feature: GYAE6OF01EAPGS.37.17.B06.1.454.CMB.1.raw
  modified_base (363)..(372): a, c, t, g, unknown or other
  misc_feature (363)..(372): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccaggggagccctggtccaccgtctcctcagcctccaccaagggccccatccggtccttcccccgtggccgccctgcctccgaggcgcacctccgagacgcacagcggccctgggctgcctggtcaaggctacttccatcacactctgagcgggctggcaaggcgcatagnnnnnnnnnn

SEQ ID NO: 143497 - DNA, 408 bp, Homo sapiens
  misc_feature: GYAE6OF01DAQBP.37.17.B06.1.454.CMB.1.raw
  modified_base (399)..(408): a, c, t, g, unknown or other
  misc_feature (399)..(408): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccagggagccctggtccaccgtctcctcacgcctccaccgaacgggcccagtccggtccttccccgtggccgccctgcctccgaggacgccaccctccggagacgccacgacggccggtccctggggcctcgcccgtggtacgaacggtaccttacgttcccaattccactactactggacgcgggctaggcaaaggcgacaagtgnnnnnnnnnn

SEQ ID NO: 143498 - DNA, 360 bp, Homo sapiens
  misc_feature: GYAE6OF01EXMNQ.37.17.B06.1.454.CMB.1.raw
  modified_base (350)..(350): a, c, t, g, unknown or other
  misc_feature (350)..(350): n is a, c, g, or t
  modified_base (356)..(360): a, c, t, g, unknown or other
  misc_feature (356)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggcccatcggtccttccccctggccgccctgctccaggagcacctccgagagcacagcggccctgggctgcctggtcaaggctacttccatctacactactgagcgggctggcaaggcncatagnnnnn

SEQ ID NO: 143499 - DNA, 360 bp, Homo sapiens
  misc_feature: GYAE6OF01AO5ZB.37.17.B06.1.454.CMB.1.raw
  modified_base (354)..(360): a, c, t, g, unknown or other
  misc_feature (354)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnn

SEQ ID NO: 143500 - DNA, 384 bp, Homo sapiens
  misc_feature: GYAE6OF01CST85.37.17.B06.1.454.CMB.1.raw
  modified_base (374)..(384): a, c, t, g, unknown or other
  misc_feature (374)..(384): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccagggagccctggtcaccgtctcctcagcctccaccaagggccccatccggtccttccccctgggccgccctgcctccagggacgccaccctccgagagccaacgagccggccctggggcctgcctggtacaaggactactccatctacactactgagcgggctggacaaggcgcatagnnnnnnnnnnn

SEQ ID NO: 143501 - DNA, 424 bp, Homo sapiens
  misc_feature: GYAE6OF01DH30T.37.17.B06.1.454.CMB.1.raw
  modified_base (410)..(424): a, c, t, g, unknown or other
  misc_feature (410)..(424): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactcctgggtcgttttgactactggggccagggagccctggtcaccgtctcctcagcctccaccgaacgggcccagtccggtccttcccccgtggccgcccctgcctccaggacgcacccgtccgagacgcacgaggccggcccgtggggcctcggcccgttgggtaccaacggtaccttacgttcccaattacctaccacttacgtggacggccgggctcgggcgaaggccgacaagtacgnnnnnnnnnnnnnnn

SEQ ID NO: 143502 - DNA, 360 bp, Homo sapiens
  misc_feature: GYAE6OF01AZSZ1.37.17.B06.1.454.CMB.1.raw
  modified_base (354)..(360): a, c, t, g, unknown or other
  misc_feature (354)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggagttttgactactggggccagggagccctggtcaccgtctcctcagcctccaccaagggcccatcggtcttcccctggcgccctgctccaggagcacctccgagagcacagcggccctgggctgcctggtcaaggctacgttccatctacactactgagcgggctggcaaggcgcatagnnnnnnn

SEQ ID NO: 143503 - DNA, 357 bp, Homo sapiens
  misc_feature: GYAE6OF01EB9NA.37.17.B06.1.454.CMB.1.raw
  modified_base (354)..(357): a, c, t, g, unknown or other
  misc_feature (354)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggcccatcggtctcccctggcgccctgctccaggagccacctccgagagcacagcggccctgggctgcctggtcaaggctacttccatctacactactgagcgggctggacaaggcgcatagnnnn

SEQ ID NO: 143504 - DNA, 360 bp, Homo sapiens
  misc_feature: GYAE6OF01COSU3.37.17.B06.1.454.CMB.1.raw
  modified_base (357)..(360): a, c, t, g, unknown or other
  misc_feature (357)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtccaccgtctcctcagcctccaccaagggcccatcggtccttccccctggccgccctgcctcaggagcacctccgagagcacagccggccctgggctgcctggtcaaggctactccatctacactactgagcgggactggcaaggcgcatagnnnn

SEQ ID NO: 143505 - DNA, 360 bp, Homo sapiens
  misc_feature: GYAE6OF01D1V94.37.17.B06.1.454.CMB.1.raw
  modified_base (273)..(273): a, c, t, g, unknown or other
  misc_feature (273)..(273): n is a, c, g, or t
  modified_base (358)..(360): a, c, t, g, unknown or other
  misc_feature (358)..(360): n is a, c, g, or t
tcagtagtgtagatcacgaccggtgctcgatttagtcgatagtgaagggccgcttcaccatctccagagactattccaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggcccatcggtcttcccctggcgccctgctccaggngcacctccgagagcacagcggcctgggctgcctggtcaaggactacttccatctacactactgagcggctggcaaggcgcatagnnn

SEQ ID NO: 143506 - DNA, 410 bp, Homo sapiens
  misc_feature: GYAE6OF01CSEZ4.37.17.B06.1.454.CMB.1.raw
  modified_base (399)..(410): a, c, t, g, unknown or other
  misc_feature (399)..(410): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactacgtggggccagggagccctggtcaccgtctcctcagcctccaccaagggcccatcggtccttccccctggccgccctgcctccgaggacgccacctccgagagccaacgacgccggtccctggggctcgcccgtgggtaccaaaggtacctactttcccaattcctaaccaacttacgtggaggccggggactgggaccaagggcgacaagtagnnnnnnnnnnnn

SEQ ID NO: 143507 - DNA, 371 bp, Homo sapiens
  misc_feature: GYAE6OF01DPQO5.37.17.B06.1.454.CMB.1.raw
  modified_base (296)..(296): a, c, t, g, unknown or other
  misc_feature (296)..(296): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (365)..(371): a, c, t, g, unknown or other
  misc_feature (365)..(371): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccagggagccctggtccaccgtctcctcagcctccaccaagggcccatccggtccttccccctggccgcccctgcctccgaggacgccacctccgagagcacnggccggccctgggctgcctggacaaggcctactccatctacactacngagcggctggcaaggcanatgnnnnnnn

SEQ ID NO: 143508 - DNA, 482 bp, Homo sapiens
  misc_feature: GYAE6OF01A34FE.37.17.B06.1.454.CMB.1.raw
  modified_base (427)..(427): a, c, t, g, unknown or other
  misc_feature (427)..(427): n is a, c, g, or t
  modified_base (429)..(432): a, c, t, g, unknown or other
  misc_feature (429)..(432): n is a, c, g, or t
  modified_base (434)..(482): a, c, t, g, unknown or other
  misc_feature (434)..(482): n is a, c, g, or t
tcagtagtgtagatcacgaccggtgctcgatttagtcgatagtgaaggggccgcttcaccactctcccaggagtactattcctaagagtcactctgtatctgacaaatgaacagcctgagtggccgtagggacacggccctatattatttgtgcgaaatggttaggggggagtgggggctactccgtggcgttttgacttacgtggggccaggggagccctggtcaccgtctcctcgacggccctccaccaacgggcccctagtccggtccttcccccgtggccgcccgtgcctccgaaggacgccacctccggagacgccacacggccggccccgtgggcctcgccgtagggtacaaacgggtctaaccgttccgatcctaactacgttacgtggacgtcggggactgggacaaaggcacagtagntnnnngnnnnnnnnnnnnnnnnnnnnnnnnnnnnnnnnnnnnnnnnnnnnnnnnn

SEQ ID NO: 143509 - DNA, 359 bp, Homo sapiens
  misc_feature: GYAE6OF01DHSMQ.37.17.B06.1.454.CMB.1.raw
  modified_base (267)..(267): a, c, t, g, unknown or other
  misc_feature (267)..(267): n is a, c, g, or t
  modified_base (355)..(359): a, c, t, g, unknown or other
  misc_feature (355)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttcccctggcgccctgctccaggngcacctccgagagcacagccggccctgggctgcctggtcaaggactacttccatctacactactgagcgggctggcaaggcgcatagnnnnn

SEQ ID NO: 143510 - DNA, 350 bp, Homo sapiens
  misc_feature: GYAE6OF01AROVX.37.17.B06.1.454.CMB.1.raw
  modified_base (319)..(319): a, c, t, g, unknown or other
  misc_feature (319)..(319): n is a, c, g, or t
  modified_base (347)..(350): a, c, t, g, unknown or other
  misc_feature (347)..(350): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttccccctggcgccctgctccaggacgcacctccgagagcacagcggccctggctgcctggcaggctactcatctacnctactgagcggctggcaaggcgcatagnnnn

SEQ ID NO: 143511 - DNA, 379 bp, Homo sapiens
  misc_feature: GYAE6OF01B6FEZ.37.17.B06.1.454.CMB.1.raw
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (363)..(363): a, c, t, g, unknown or other
  misc_feature (363)..(363): n is a, c, g, or t
  modified_base (370)..(379): a, c, t, g, unknown or other
  misc_feature (370)..(379): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctgggtcgttttgactacgtgggggccagggacgccctggtccaccgtctcctcacgcctccaccaagggcccatcggtccttcccccgtggccgccctgcctccgaggcgcacctcgagngcacngccggcctgggctcgcctggtcaaggtctactccatcacgactactgagcgggctggacgaaggtcncagtagnnnnnnnnnn

SEQ ID NO: 143512 - DNA, 382 bp, Homo sapiens
  misc_feature: GYAE6OF01DFU0E.37.17.B06.1.454.CMB.1.raw
  modified_base (372)..(382): a, c, t, g, unknown or other
  misc_feature (372)..(382): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccaggggacgccctggtcaccgtctcctcagccctcccaccaacgggccccatccggtccttccccctgggccgcccctgcctccagggacgccacctccgagagcacagccggcctgggctgcctggtcaaggctacttccatctacactactgagcgggctggcaaggcgacagtagnnnnnnnnnnn

SEQ ID NO: 143513 - DNA, 359 bp, Homo sapiens; identical to SEQ ID NO: 143445
  misc_feature: GYAE6OF01ARDM7.37.17.B06.1.454.CMB.1.raw
  modified_base (354)..(359): a, c, t, g, unknown or other
  misc_feature (354)..(359): n is a, c, g, or t

SEQ ID NO: 143514 - DNA, 387 bp, Homo sapiens
  misc_feature: GYAE6OF01CTYEI.37.17.B06.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
  modified_base (359)..(387): a, c, t, g, unknown or other
  misc_feature (359)..(387): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggcctatattattgtgcgaaatggtggggggagtgggggctactcctgggcgttttgactactggggccagggagccctggtcaccgtctcctcagcctccaccaagggcccatccggtcttccccctggccnccctgctccaggngcacctccgaagngcacngcggccctgggctgcctgtcaaggctactccatcacactacngagcgggctggacaaggcgcaagtagnannnnnnnnnnnnnnnnnnnnnnnnnnnnn

SEQ ID NO: 143515 - DNA, 403 bp, Homo sapiens
  misc_feature: GYAE6OF01B5P0T.37.17.B06.1.454.CMB.1.raw
  modified_base (282)..(282): a, c, t, g, unknown or other
  misc_feature (282)..(282): n is a, c, g, or t
  modified_base (392)..(403): a, c, t, g, unknown or other
  misc_feature (392)..(403): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgacgaaatggtggggggagtgggggctactcctggcgttttgactacgtggggccagggagccctggtccaccgtctcctcacgcctccaccgaagggcccagtccggtccttcccccgtggccgccctgcctccgaggacnccacctccggagacgcacacgccggcccgtgggctcggccttggtacaaggtacctcttaccattccgtacactactgacggcgggtactggacgaacggcgacagtagnnnnnnnnnnnn

SEQ ID NO: 143516 - DNA, 358 bp, Homo sapiens; identical to SEQ ID NO: 143440
  misc_feature: GYAE6OF01EXRJO.37.17.B06.1.454.CMB.1.raw
  modified_base (354)..(358): a, c, t, g, unknown or other
  misc_feature (354)..(358): n is a, c, g, or t

SEQ ID NO: 143517 - DNA, 452 bp, Homo sapiens
  misc_feature: GYAE6OF01EA53L.37.17.B06.1.454.CMB.1.raw
  modified_base (435)..(452): a, c, t, g, unknown or other
  misc_feature (435)..(452): n is a, c, g, or t
tcagtagtgtagatcacgaccggtgctcgatttagtcgatagtgaagggccgcttcaccatctccagagactattccaagagcactctgtatctgcaaatgaacagcctgagtgccgagacacggccctatattattgtgcgaaatggtggggggagtgggggctactcctggtcgttttgactacgtggggccagggcgcccgtggtccaccgtctcctcacgccctccaaccgaacgggccccagtccggtccctttcccccgtggcccgtccctgcctccgaggacgccacccgtccgagacgaccacgacggtcccggccccgttgggccttcggccgtgggtaccgaaacggtacccttaccttcccgaacttcctaacctacgttaccgtggacggtcggggctacggacgtaacggccacgagtacgnnnnnnnnnnnnnnnnnn

SEQ ID NO: 143518 - DNA, 399 bp, Homo sapiens
  misc_feature: GYAE6OF01CYZM5.37.17.B06.1.454.CMB.1.raw
  modified_base (391)..(399): a, c, t, g, unknown or other
  misc_feature (391)..(399): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggtcgttttgactacgtggggccaggggagccctggtcaccgtctcctcagcctccaccaagggcccatccggtcttccccctggccgccctgcctccgaggacgccacccgtcccgagacgccaacacggccggccccgtggggcctcggcccgttggtacaacggtaccttacctccgatctacactactggacggcgggctggacaaggcgcatagnnnnnnnnn

SEQ ID NO: 143519 - DNA, 436 bp, Homo sapiens
  misc_feature: GYAE6OF01DUXAY.37.17.B06.1.454.CMB.1.raw
  modified_base (315)..(315): a, c, t, g, unknown or other
  misc_feature (315)..(315): n is a, c, g, or t
  modified_base (385)..(385): a, c, t, g, unknown or other
  misc_feature (385)..(385): n is a, c, g, or t
  modified_base (417)..(436): a, c, t, g, unknown or other
  misc_feature (417)..(436): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggtagtgggggctactccgttggtcgttttgactacgtgggggccagggacgccccgtgggtcaccggtcctcctcgacgccctccgaccgaacgggccccagtcccggtccttccccccgtggccgtcccctgcctccgaggacgccaccgtccgagacncgacaggtccggcccgtgggctcgccgtggtaccgaacggaccttacttcccattacctaacacttacgnggacgcggggctggaccgaaggcgactagagnnnnnnnnnnnnnnnnnnnn

SEQ ID NO: 143520 - DNA, 371 bp, Homo sapiens
  misc_feature: GYAE6OF01BDLXJ.37.17.B06.1.454.CMB.1.raw
  modified_base (358)..(371): a, c, t, g, unknown or other
  misc_feature (358)..(371): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagacgcacacgccggccctgggctgcctggtcaaggactacttccatctacactactgacgcgggctggcaaggcgcatagnnnnnnnnnnnnnn

SEQ ID NO: 143521 - DNA, 357 bp, Homo sapiens
  misc_feature: GYAE6OF01CZWYP.37.17.B06.1.454.CMB.1.raw
  modified_base (329)..(329): a, c, t, g, unknown or other
  misc_feature (329)..(329): n is a, c, g, or t
  modified_base (355)..(357): a, c, t, g, unknown or other
  misc_feature (355)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtccaccgtctcctcagcctccaccaagggcccatcggtcttcccctggcgccctgctccaggagcacctcgagagcacagcggccctgggctgcctggtcaaggctacttccatctacactacngagcgggctggcaaaggcgtcatagnnn

SEQ ID NO: 143522 - DNA, 360 bp, Homo sapiens
  misc_feature: GYAE6OF01BXISY.37.17.B06.1.454.CMB.1.raw
  modified_base (352)..(360): a, c, t, g, unknown or other
  misc_feature (352)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcggctggcaaggcgcatagnnnnnnnnn

SEQ ID NO: 143523 - DNA, 397 bp, Homo sapiens
  misc_feature: GYAE6OF01BZKLG.37.17.B06.1.454.CMB.1.raw
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (353)..(353): a, c, t, g, unknown or other
  misc_feature (353)..(353): n is a, c, g, or t
  modified_base (375)..(397): a, c, t, g, unknown or other
  misc_feature (375)..(397): n is a, c, g, or t
tcagtagtgtagatcacgaccggtgctcgatttagtcgatagtgaagggccgcttcaccatctccagagactattccaagagcactctgtatctgcaaatgaacagcctgagtgcgaggacacggcctatattattgtgacgaaatggtggggggagtgggggctactccgtggtcgttttgactacgtggggccagggacgcccgtggtccaccgtctcctcacgcctccacgaacggccagtccgtcctccccgtggccncctgctcgaggcnccacctcgagagcacgcgccggcccgtgggctcgccgtggacaagcctacttccatcctaacactactggacggcggntcgggacgaaggccgatagagnnnnnnnnnnnnnnnnnnnnnnn

SEQ ID NO: 143524 - DNA, 390 bp, Homo sapiens
  misc_feature: GYAE6OF01CG8Y2.37.17.B06.1.454.CMB.1.raw
  modified_base (353)..(353): a, c, t, g, unknown or other
  misc_feature (353)..(353): n is a, c, g, or t
  modified_base (380)..(390): a, c, t, g, unknown or other
  misc_feature (380)..(390): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtgttttgactacgtggggccagggagccctggtcaccgtctcctcagcctccaccaagggcccatccggtccttcccccgtggccgccctgcctccaggacgccaccctccggagagccacgacgccggccctggggctcggccgtggtacaacggacctaccttccatctacactacngagcgggctggacaaggccgacatagnnnnnnnnnnn

SEQ ID NO: 143525 - DNA, 393 bp, Homo sapiens
  misc_feature: GYAE6OF01BJH61.37.17.B06.1.454.CMB.1.raw
  modified_base (200)..(200): a, c, t, g, unknown or other
  misc_feature (200)..(200): n is a, c, g, or t
  modified_base (380)..(393): a, c, t, g, unknown or other
  misc_feature (380)..(393): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccagggngccctggtcaccgtctcctcagcctccaccgaagggcccagtccggtccttcccccgtggccgccctgcctccgaggacgccacctccgagacgcacgacgccggcccgtgggctcgccgtggtcaaggtctactccatcctacactactggacgcgggctgggacaaggtcgacatagnnnnnnnnnnnnnn

SEQ ID NO: 143526 - DNA, 419 bp, Homo sapiens
  misc_feature: GYAE6OF01EQHNB.37.17.B06.1.454.CMB.1.raw
  modified_base (407)..(419): a, c, t, g, unknown or other
  misc_feature (407)..(419): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatatttattgtgcgaaatggtgggggggagtgggggctactccgtggtcgttttgactacgtgggggccaggggagccctggtcaccgtctcctcacgcctccaccgaagggcccctatccggtcccttccccctgggccgccctgcctccgaggacgccacccgtccggaagacgcacgaggccggcccgtggggcctggcccgtgggtacaaacgggtccttaacgttccaatcctaacactacgtggacggcgggctggacaaggcgacatagnnnnnnnnnnnnn

SEQ ID NO: 143527 - DNA, 370 bp, Homo sapiens
  misc_feature: GYAE6OF01DR8RH.37.17.B06.1.454.CMB.1.raw
  modified_base (364)..(370): a, c, t, g, unknown or other
  misc_feature (364)..(370): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccaggggcgccctggtcaccgtctcctcagccctccaccaacgggcccatccggtccttccccctggccgccctgctccaggagccacctccgagagcacagccggccctgggctgcctggtcaaggactacttccatctacactactgagccgggctggcaaggcgcatagnnnnnnn

SEQ ID NO: 143528 - DNA, 478 bp, Homo sapiens
  misc_feature: GYAE6OF01E1VMP.37.17.B06.1.454.CMB.1.raw
  modified_base (435)..(437): a, c, t, g, unknown or other
  misc_feature (435)..(437): n is a, c, g, or t
  modified_base (439)..(478): a, c, t, g, unknown or other
  misc_feature (439)..(478): n is a, c, g, or t
tcagtagtgtagatcacgaccggtgctcgattttagtcgatagtgaagggccgcgttcaccatctccagagactattccaagagcactctgtatctgcaaatgaacagcctgagtgccgaggacacggccctatattattgtgcgaaatgtggggggagtgggggctactcctggcgttttgactactggggccaggggagccctggtcacccgtctcctcgacgccctcccaaccgaaacgggggtcccctaagttccgggttccctttccccccccgttggggcccgccccgttcgccttcccgagggaacgccgacccctcccggagacggccaccaggccggccccttggggcctggcccctggggtccaaacgggacctacgttcccattcctaacacctacttgacgcgggctggcaaggcgcagtggnnngnnnnnnnnnnnnnnnnnnnnnnnnnnnnnnnnnnnnnnnn

SEQ ID NO: 143529 - DNA, 427 bp, Homo sapiens
  misc_feature: GYAE6OF01D5IVO.37.17.B06.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
  modified_base (408)..(427): a, c, t, g, unknown or other
  misc_feature (408)..(427): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggggagtggggggctactccgtggtcgttttgactacgtggggccagggngccctggtcaccgtctcctcagcctaccaccgaaccgggccatccggtccttccccctgggcctacccgtgcctaccagggacgccacccgtccgagagccacgagcggcccgtggctcggcccgtggtaccaacggtaccttaccttccgacttctaacctactacgtgacgggtcgggactcggacgaagggccnaataggnnnnnnnnnnnnnnnnnnnn

SEQ ID NO: 143530 - DNA, 402 bp, Homo sapiens
  misc_feature: GYAE6OF01BL5OO.37.17.B06.1.454.CMB.1.raw
  modified_base (372)..(373): a, c, t, g, unknown or other
  misc_feature (372)..(373): n is a, c, g, or t
  modified_base (383)..(383): a, c, t, g, unknown or other
  misc_feature (383)..(383): n is a, c, g, or t
  modified_base (389)..(390): a, c, t, g, unknown or other
  misc_feature (389)..(390): n is a, c, g, or t
  modified_base (392)..(402): a, c, t, g, unknown or other
  misc_feature (392)..(402): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacaccggccctatattattgtgacgaaatggtggggggagtgggggctactccgtggtcgttttgactacgtggggccagggacgccctggtcctacccgtcctcctcacgccctaccaaccgaacgggccccaagttccggtcccttcccccgtggccgtccctgcctaccgagggcccacctccggagacgcacagccgcccgtggcctgccgtggtacaaggcctacttcatcacactacgtgagcggnngggcaaggcnagtagnngnnnnnnnnnnn

SEQ ID NO: 143531 - DNA, 379 bp, Homo sapiens
  misc_feature: GYAE6OF01E0YU2.37.17.B06.1.454.CMB.1.raw
  modified_base (261)..(261): a, c, t, g, unknown or other
  misc_feature (261)..(261): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (368)..(379): a, c, t, g, unknown or other
  misc_feature (368)..(379): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactcctggcgttttgactactggggccagggagccctggtcaccgtctcctcacgcctccaccaagggcccatccggtccttccccctgggccnccctgcctccaggacgcaccgtccgagagcacagcggccctgggctcgccgtggtcaaggacctacttccatctacactactgacgcggntcggcaaggcanatcgnnnnnnnnnnnn

SEQ ID NO: 143532 - DNA, 358 bp, Homo sapiens
  misc_feature: GYAE6OF01DKUOJ.37.17.B06.1.454.CMB.1.raw
  modified_base (352)..(358): a, c, t, g, unknown or other
  misc_feature (352)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaggactacttccatctacactactgagcggctggcaaggcgcatagnnnnnnn

SEQ ID NO: 143533 - DNA, 428 bp, Homo sapiens
  misc_feature: GYAE6OF01EKAUM.37.17.B06.1.454.CMB.1.raw
  modified_base (415)..(428): a, c, t, g, unknown or other
  misc_feature (415)..(428): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattactgtacgaaaatggcctacggatatgactatattgggactggtacttcgatctcgtggggccgtggccacccgtggtcacttcgtcctcctcacgccctccaaccgaacgggccccagttccggtcccttcccccgtggccgcccctgcctccgaggacgccacccgtccggagacgccacgacggccgggccccgtggggcctcgccgtggtacaacggtaccttacctccatcctaacacctacgtggacggcgggctggacgaagggcgatatggnnnnnnnnnnnnnn

SEQ ID NO: 143534 - DNA, 498 bp, Homo sapiens
  misc_feature: GYAE6OF01E1LC4.37.17.B06.1.454.CMB.1.raw
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (448)..(449): a, c, t, g, unknown or other
  misc_feature (448)..(449): n is a, c, g, or t
  modified_base (451)..(498): a, c, t, g, unknown or other
  misc_feature (451)..(498): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgggtgggggggagtgggggctactccgtgggtcgtttttgactacgtggggccaggggacgcccgtggtccaccgtctcctcacgccctccaccgaagggcccatccggtcccttccccgngggcccnccctgcctccgagggacgccacccgtccggaagcgcaacgcggccggccccgtggggcctcggccgtcgggtacaaaccgggtaccttaccgttacccacttacctaacctaacttaccggtaggacgggtccgggccgttacggggacgaaaccgggccgacgtagtacggnngnnnnnnnnnnnnnnnnnnnnnnnnnnnnnnnnnnnnnnnnnnnnnnnn

SEQ ID NO: 143535 - DNA, 449 bp, Homo sapiens
  misc_feature: GYAE6OF01D2QPJ.37.17.B06.1.454.CMB.1.raw
  modified_base (408)..(408): a, c, t, g, unknown or other
  misc_feature (408)..(408): n is a, c, g, or t
  modified_base (412)..(449): a, c, t, g, unknown or other
  misc_feature (412)..(449): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgacgaaagtgggtgggggggaggtgggggctactccgtggtcgttttgactacgtggggccgagggcgcccgtggtcaccgtctcctcacgccctaccgaaccgaacgggcccacgtccgggtcccttccccccgtggcccgcccctgcctaccgaggacgccacctccgaagacgcacgacggccggccgtgggctcgcctggcaaggtcctacttccagtcctacactaacgtgacggcgggctggacgaacggcgctaagtaggnacgnnnnnnnnnnnnnnnnnnnnnnnnnnnnnnnnnnnnnn

SEQ ID NO: 143536 - DNA, 420 bp, Homo sapiens
  misc_feature: GYAE6OF01CDD2Z.37.17.B06.1.454.CMB.1.raw
  modified_base (402)..(420): a, c, t, g, unknown or other
  misc_feature (402)..(420): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctctattactgtgcgagagatcagacggagtatagcagcagctctgactacgtggggccacggaaccctggtcaccgtctcctcacgcctccaccgaacgggcccagtccggtcccttcccccgtcggcctacccctcctaccaagacgccaccgtcgtcgggggccacgacggccggcccgtgggccgtcgccgtgggtaccgaacggtaccttaccgttccatcctaacacttacgtggacggcgggcgtggacgaaacggcgacagtagcnnnnnnnnnnnnnnnnnnn

SEQ ID NO: 143537 - DNA, 450 bp, Homo sapiens
  misc_feature: GYAE6OF01B3TEL.37.17.B06.1.454.CMB.1.raw
  modified_base (254)..(254): a, c, t, g, unknown or other
  misc_feature (254)..(254): n is a, c, g, or t
  modified_base (389)..(389): a, c, t, g, unknown or other
  misc_feature (389)..(389): n is a, c, g, or t
  modified_base (397)..(450): a, c, t, g, unknown or other
  misc_feature (397)..(450): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactcctgggcgttttgactagtggggccagggagccctggtcaccgtctcctcagcctccaccgaagggcccatcggtcctcccccnggcgccctgctccgaggacgccacctccggagacgcaacgacggccggaccctggggctcgccgtggtacaaaggaccttaacgttcccaattcaacgtactaactggacggcgggtcctagggacaaggccganaagtcgannnnnnnnnnnnnnnnnnnnnnnnnnnnnnnnnnnnnnnnnnnnnnnnnnnnnn

SEQ ID NO: 143538 - DNA, 447 bp, Homo sapiens
  misc_feature: GYAE6OF01D8M9C.37.17.B06.1.454.CMB.1.raw
  modified_base (289)..(289): a, c, t, g, unknown or other
  misc_feature (289)..(289): n is a, c, g, or t
  modified_base (418)..(447): a, c, t, g, unknown or other
  misc_feature (418)..(447): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacaccggccctatattattgtgcgaaatggtggggggagtgggggctactcctggtcgttttgactacgtggggccgagggacgccctggtccaccgtcctcctcacgccctccaacccgaacgggccccagtccggtccttcccccgtggccgccctgcctccgaggnccacctccgagacgcacacggccgcccgtgggcctcggtcctgggtacaaacggtaccttacctttccaacttcctaacctacctacgtcggacggccgggactgggaccgaaaggtccgactaatggnnnnnnnnnnnnnnnnnnnnnnnnnnnnnn

SEQ ID NO: 143539 - DNA, 361 bp, Homo sapiens
  misc_feature: GYAE6OF01DSW88.37.17.B06.1.454.CMB.1.raw
  modified_base (251)..(251): a, c, t, g, unknown or other
  misc_feature (251)..(251): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (357)..(361): a, c, t, g, unknown or other
  misc_feature (357)..(361): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggcccatccggtcttccccnggccgccctgctccaggacgcacctcgagagcacagccggccctggggctggcctggtcaaggactacttccatctacactacngagcgggctggcaaggcnatgnnnnn

SEQ ID NO: 143540 - DNA, 479 bp, Homo sapiens
  misc_feature: GYAE6OF01D12F9.37.17.B06.1.454.CMB.1.raw
  modified_base (421)..(421): a, c, t, g, unknown or other
  misc_feature (421)..(421): n is a, c, g, or t
  modified_base (425)..(431): a, c, t, g, unknown or other
  misc_feature (425)..(431): n is a, c, g, or t
  modified_base (433)..(479): a, c, t, g, unknown or other
  misc_feature (433)..(479): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactcctggtcgttttgactacgtgggggccaggggacgccctgggtccacccgtcctcctcacgccctccaccgaacgggccccagtccggtccttcccccgtggccgccctgcctccgaggacgccacctcgagacgcacgaggccggcccgtggggcctcggccgttggtacgaagggtaccttaccgttccattctaaccacttacgtggacggccggggctacgggacgaacgggccgacgtaagtaggnagcnnnnnnnannnnnnnnnnnnnnnnnnnnnnnnnnnnnnnnnnnnnnnnnnnnnnn

SEQ ID NO: 143541 - DNA, 366 bp, Homo sapiens
  misc_feature: GYAE6OF01A6RCE.37.17.B06.1.454.CMB.1.raw
  modified_base (356)..(366): a, c, t, g, unknown or other
  misc_feature (356)..(366): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggcctgcctggtcaaggctacttccatctacactactgacgcggctggcaaggcgacatagnnnnnnnnnnn

SEQ ID NO: 143542 - DNA, 413 bp, Homo sapiens
  misc_feature: GYAE6OF01EUBUS.37.17.B06.1.454.CMB.1.raw
  modified_base (403)..(413): a, c, t, g, unknown or other
  misc_feature (403)..(413): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccagggacgccctggtccaccgtctcctcacgcctccaccgaacgggccccatccggtccttcccccgtggccgccctgcctccgaggacgcccaccgtccgagacgccacgacggccggccccgtggggcctcgccgtgggtcaaacggtaccttaccttccatcctacctactacgtggacggccgggctcgggacaacggcacatgnnnnnnnnnnn

SEQ ID NO: 143543 - DNA, 351 bp, Homo sapiens
  misc_feature: GYAE6OF01CNF9N.37.17.B06.1.454.CMB.1.raw
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (318)..(318): a, c, t, g, unknown or other
  misc_feature (318)..(318): n is a, c, g, or t
  modified_base (345)..(351): a, c, t, g, unknown or other
  misc_feature (345)..(351): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctcacaagggccatcggtctcccctggcgcctgctcaggancactcgagagcacagcgccngggctgccnggtcaaggctactccatctacactacngagcgggctgggcaaaggtcgcatagnnnnnnn

SEQ ID NO: 143544 - DNA, 413 bp, Homo sapiens
  misc_feature: GYAE6OF01B876C.37.17.B06.1.454.CMB.1.raw
  modified_base (285)..(285): a, c, t, g, unknown or other
  misc_feature (285)..(285): n is a, c, g, or t
  modified_base (396)..(413): a, c, t, g, unknown or other
  misc_feature (396)..(413): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggcctatattattgtgcgaaatgggtggggggaggtgggggctactccgtggtcgttttgactacgtggggccaggggagccctggtcaccgtctcctcagccctccaccgaacgggcccagtccggtccttcccccgtggccgccctgcctccgaggacnccacctccgagacgcacgagccggcccgtgggactcggccgtaggaccaaggtacctacgttccaattccactactacgtggacggcgggctggacgaaggcgacagtagnnnnnnnnnnnnnnnnnn

SEQ ID NO: 143545 - DNA, 434 bp, Homo sapiens
  misc_feature: GYAE6OF01AT63F.37.17.B06.1.454.CMB.1.raw
  modified_base (105)..(105): a, c, t, g, unknown or other
  misc_feature (105)..(105): n is a, c, g, or t
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (387)..(388): a, c, t, g, unknown or other
  misc_feature (387)..(388): n is a, c, g, or t
  modified_base (391)..(434): a, c, t, g, unknown or other
  misc_feature (391)..(434): n is a, c, g, or t
tcagtagtgtagatcacgaccggtgctcgatttagtcgatagtgaagggccgcttcaccatctccagagactattccaagagcactctgtatctgcaaatgaacngcctgagtgccgaggacacggccctatattattgtgcgaaatggtggggggagtgggggctactccgtggtcgttttgactacgtgggggccagggagccctgtcaccgtctcctcancctccaccgacgggcccatcggtccttcccccngggccnccctgcctccgaggacgcgacctccgagagaccacgacgcggaccccgtgggctgtcccgtggtacaacgtacctacttccatctaccatcctaggacgcggcgtggcgaacggcgacatacggnngannnnnnnnnnnnnnnnnnnnnnnnnnnnnnnnnnnnnnnnnnnn

SEQ ID NO: 143546 - DNA, 360 bp, Homo sapiens
  misc_feature: GYAE6OF01BPVLP.37.17.B06.1.454.CMB.1.raw
  modified_base (268)..(268): a, c, t, g, unknown or other
  misc_feature (268)..(268): n is a, c, g, or t
  modified_base (355)..(360): a, c, t, g, unknown or other
  misc_feature (355)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttccccctggcgccctgctccaggngcacctccgagagcacagcggccctgggctgcctggtcaaggactacttccatctacactactgagcgggctggcaaggcgcatagnnnnnn

SEQ ID NO: 143547 - DNA, 407 bp, Homo sapiens
  misc_feature: GYAE6OF01BGO89.37.17.B06.1.454.CMB.1.raw
  modified_base (261)..(261): a, c, t, g, unknown or other
  misc_feature (261)..(261): n is a, c, g, or t
  modified_base (354)..(354): a, c, t, g, unknown or other
  misc_feature (354)..(354): n is a, c, g, or t
  modified_base (394)..(407): a, c, t, g, unknown or other
  misc_feature (394)..(407): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggcctatattattgtgcgaaatggtggggggaggtgggggctactccgtggtcgttttgactacgtggggccagggacgccctggtccaccgtctcctcagcctccaccgaagggcccagtccggtccttcccccgnggccgccctgcctccgagggacgccacctccggagacgcaacgagccggcccgtgggcctgccgtggtacaaggtcctacttccaatctaacnctacgtggacggccgggctgggacaacggcacaagtacgnnnnnnnnnnnnnn

SEQ ID NO: 143548 - DNA, 632 bp, Homo sapiens
  misc_feature: GYAE6OF01BZ0UK.37.17.B06.1.454.CMB.1.raw
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
  modified_base (550)..(551): a, c, t, g, unknown or other
  misc_feature (550)..(551): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (567)..(568): a, c, t, g, unknown or other
  misc_feature (567)..(568): n is a, c, g, or t
  modified_base (576)..(579): a, c, t, g, unknown or other
  misc_feature (576)..(579): n is a, c, g, or t
  modified_base (585)..(585): a, c, t, g, unknown or other
  misc_feature (585)..(585): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (595)..(596): a, c, t, g, unknown or other
  misc_feature (595)..(596): n is a, c, g, or t
  modified_base (598)..(599): a, c, t, g, unknown or other
  misc_feature (598)..(599): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (606)..(607): a, c, t, g, unknown or other
  misc_feature (606)..(607): n is a, c, g, or t
  modified_base (612)..(612): a, c, t, g, unknown or other
  misc_feature (612)..(612): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (630)..(630): a, c, t, g, unknown or other
  misc_feature (630)..(630): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggcctatattattgtgcgaaatggtgggggagtggggctactccgtggtcgttttgactacgtcggggccgagggacgtcccgtggtccaccgttccgtcctcgacgtcctaccgaaccgaacgggccctaacgttccgggtccctttcccccgtggccgtcccgtgcctaccgaacggtacgacctacccgtaccggaaggacgaccgaacgacggcccggtaccccggttcggggtccttccggacccggtttagggtaacccgaaaacgggtaccttttaaaccgttcccgtaaacgttaccttaaccgtaaacgttaccgttacggaaccgggtccgggtacggttacgggaaccggtaaacgggaccgacgtaaacggttagcgactcgtagtctaaggngtacgtcncgcgcgtcgtcgnngngcnctntcgcgagnngctacacnnnncgtagntcncgcgncnncnngcncncnngtcancgcgngncgcnancncgngc

SEQ ID NO: 143549 - DNA, 482 bp, Homo sapiens
  misc_feature: GYAE6OF01CIXWH.37.17.B06.1.454.CMB.1.raw
  modified_base (458)..(482): a, c, t, g, unknown or other
  misc_feature (458)..(482): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactcctggtcgttttgactacgtggggccaggggacgccctggtcaccgtctcctcacgcctccaccgaacgggccccagtccggtccttcccccgtggccgcccctgcctccgaggacgccacccgtcccgagacgccaacgacggcccggccccgtgggggcctcggtccccgttagggtaccgaaaacgggtaccctttaacccgttacccaacttaccctaaccgtaaccttaccgtagggtacgggccggggtacctcgggaccgaacgggccgactaagtaggcnnnnnnnnnnnnnnnnnnnnnnnnn

SEQ ID NO: 143550 - DNA, 456 bp, Homo sapiens
  misc_feature: GYAE6OF01EGYFL.37.17.B06.1.454.CMB.1.raw
  modified_base (428)..(456): a, c, t, g, unknown or other
  misc_feature (428)..(456): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacaccggcctatattattgtgacgaaagtggtgggggggaggtgggggctactccgtggtcgttttgactacgtggggccgagggcgcccgtggtccacccgtctccctcacgccctacccaaccgaacgggcccctagttcccggttcccttccccccgtggcccgccctcgcctccgacggacgccaccgtccgagacgtttcacgacggccggccgtgggcgtcgccgtcggacgaacggtacctaccttccactctactactacgtcggacggcgggtcgtacggacgaacggcgacgagtagnnnnnnnnnnnnnnnnnnnnnnnnnnnnn

SEQ ID NO: 143551 - DNA, 429 bp, Homo sapiens
  misc_feature: GYAE6OF01CKZIA.37.17.B06.1.454.CMB.1.raw
  modified_base (267)..(267): a, c, t, g, unknown or other
  misc_feature (267)..(267): n is a, c, g, or t
  modified_base (405)..(429): a, c, t, g, unknown or other
  misc_feature (405)..(429): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggcctatattattgtgcgaaatggtggggggagtgggggctactcctggtcgttttgactacgtggggccagggacgcccgtggtcaccgtctcctcacgcctccaacgaacgggcccagtccggtccttcccccgtggcccncccgtagcctccgaagggacgtccaccgtccgagacgcaacgacggtccggcccgtaggggctcggcctggtacaagccttactcagtctaactactacgtggacggacggcgtcggacgaacggtcacgtaagtagnnnnnnnnnnnnnnnnnnnnnnnnn

SEQ ID NO: 143552 - DNA, 529 bp, Homo sapiens
  misc_feature: GYAE6OF01EUG66.37.17.B06.1.454.CMB.1.raw
  modified_base (467)..(472): a, c, t, g, unknown or other
  misc_feature (467)..(472): n is a, c, g, or t
  modified_base (477)..(478): a, c, t, g, unknown or other
  misc_feature (477)..(478): n is a, c, g, or t
  modified_base (483)..(484): a, c, t, g, unknown or other
  misc_feature (483)..(484): n is a, c, g, or t
  modified_base (486)..(529): a, c, t, g, unknown or other
  misc_feature (486)..(529): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgacgaaatgggtggggggaggtgggggctactcgtggtgttttgactacggtcggggccgaggggactcccgtgggtccgacccggttcctcccgtcacgtcccctaccaaccgaaccggggccctacgttcccgggttcccctttcccccggtgggcccgtccctacgcctacccggagaccgcccgtaccgaccgagaccgaccacggccggccggtccggtcggtccgtcggtccggtacggtaacgtaaccggtccttaccgtactactacctaactacgtacgtcgggacgggcgggtacgtcgggaacgacggcagtagannnnnnacgtnnagcanncnnnnnnnnnnnnnnnnnnnnnnnnnnnnnnnnnnnnnnnnnnnn

SEQ ID NO: 143553 - DNA, 399 bp, Homo sapiens
  misc_feature: GYAE6OF01BP6GV.37.17.B06.1.454.CMB.1.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
  modified_base (361)..(399): a, c, t, g, unknown or other
  misc_feature (361)..(399): n is a, c, g, or t
tcagtagtgtagatcacgaccggtgctcgatttagtcgatagtgaagggccgcttcaccatctccagagactattccaagagtactctgtatctgcaaatgaacagcctgagtgccgaggacacggcctatattactgtacgaaaatggcctacggatatgactactattgggactggtacttcgatctgtggggccgtggcacctggtcactgtctcctcagcctcaccgaagggcccaatcggtccctccccgtggccgccctgctccgaggncaccncgagagcanaggcgcctggctgcctgtnaaggctactccatctaacactacgtgagccggcgtgacgaaggcncgaatagnnnnnnnnnnnnnnnnnnnnnnnnnnnnnnnnnnnnnnn

SEQ ID NO: 143554 - DNA, 491 bp, Homo sapiens
  misc_feature: GYAE6OF01BZMXU.37.17.B06.1.454.CMB.1.raw
  modified_base (137)..(137): a, c, t, g, unknown or other
  misc_feature (137)..(137): n is a, c, g, or t
  modified_base (156)..(156): a, c, t, g, unknown or other
  misc_feature (156)..(156): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (434)..(436): a, c, t, g, unknown or other
  misc_feature (434)..(436): n is a, c, g, or t
  modified_base (440)..(491): a, c, t, g, unknown or other
  misc_feature (440)..(491): n is a, c, g, or t
tcagtagtgtagatcacgaccggtgctcgatttagtcgatagtgaagggccgcgttcacatctccagagactattccaagagcactctgtatctgcaaatgaaacagcctgagtcgccgaggacaccggccctaatnttattgtgacgaaatgggnggggggagtgggggcctactcctggtcgttttgactacgtgggcagggcnccctggtccaccgtctccncacgcctccaacgaacgggcccagttccggtccttcccccgtggcctccctgcctcgaggtacncctaaccgtcccggagaacncctaacgcggccggtccccgtgggactcgccgtaggtaccaaggacctttacctccactttcccgactaacctttgacggacggccggggtactgggaccaagggctactaagcngnatcgantnnntagnnnnnnnnnnnnnnnnnnnnnnnnnnnnnnnnnnnnnnnnnnnnnnnnnnnn

SEQ ID NO: 143555 - DNA, 448 bp, Homo sapiens
  misc_feature: GYAE6OF01BOV4L.37.17.B06.1.454.CMB.1.raw
  modified_base (409)..(448): a, c, t, g, unknown or other
  misc_feature (409)..(448): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactcctggtcgttttgactacgtgggggccaggggacgcccgttggtccaccgtctcctcagcctccaccaagggcccagtccggtccttcccccgtggccgtccctgcctccaggcgccaccgtcgagacgcaacgacggcccggcccgtgggcctcggcccggttggacgaagggaccttacgttccatcctaacacttacgtggacggcgggtctacggacgaacggcacgtaagtcgnnnnnnnnnnnnnnnnnnnnnnnnnnnnnnnnnnnnnnnn

SEQ ID NO: 143556 - DNA, 472 bp, Homo sapiens
  misc_feature: GYAE6OF01CWDBZ.37.17.B06.1.454.CMB.1.raw
  modified_base (443)..(472): a, c, t, g, unknown or other
  misc_feature (443)..(472): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccaggggacgcccgtggtccaccgtcctcctcgacgccctacccaccgaacgggccccagttccggtcccttccccccgtgggcccgccctgcctccgaagggacgccacccgtccggaggacgccacgaggcccgggccccgtggggcctcggcccgttgggtaccaacgggaccttacctttccgacttcctaaccacttacgtggtacggccggggtcgtagggaccaagggccgacgaacgtaggnnnnnnnnnnnnnnnnnnnnnnnnnnnnnn

SEQ ID NO: 143557 - DNA, 428 bp, Homo sapiens
  misc_feature: GYAE6OF01B0SSB.37.17.B06.1.454.CMB.1.raw
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (393)..(428): a, c, t, g, unknown or other
  misc_feature (393)..(428): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggcctatattattgtgcgaaatggtggggggagtgggggctactcctggtcgtttgactacgtgggcgagggacgcctggtcaccgtctcctcagccacaccaagggcccagtccggtccttccccgtggccgccctggcctccgacggacgccgacctaccggagagtacaaccgagccggccccgtggggactcgccctaggtacaaggaccttaacttccagttcaacactagngaaggcgggntcggacgaaggtcacgataagnnnnnnnnnnnnnnnnnnnnnnnnnnnnnnnnnnnn

SEQ ID NO: 143558 - DNA, 451 bp, Homo sapiens
  misc_feature: GYAE6OF01CD1TG.37.17.B06.1.454.CMB.1.raw
  modified_base (113)..(113): a, c, t, g, unknown or other
  misc_feature (113)..(113): n is a, c, g, or t
  modified_base (205)..(205): a, c, t, g, unknown or other
  misc_feature (205)..(205): n is a, c, g, or t
  modified_base (268)..(268): a, c, t, g, unknown or other
  misc_feature (268)..(268): n is a, c, g, or t
  modified_base (435)..(451): a, c, t, g, unknown or other
  misc_feature (435)..(451): n is a, c, g, or t
tcagtagtgtagatcacgaccggtgctcgatttagtcgatagtgaagggccgcttcaccatctccagagactattccaagagcactctgtatctgacaaatgaacagctgagngccgaggacacggcctatattattgtacgaaatggtggggggaggtgggggctactccgtggtcgttttgactacggtggggccaagggacncccgtggtccaccgtcctcctcgacgccctaccaccgaacgggcccagtcggtcccttccccngggccgtcccctgcctcccgaggactccacctccggagacgcaaccgacggcccggccgtcgggacttcggcccgttacggacgtaaaggtacccttaaccttaccacttaccgtaaaccacttaacgtggaacggtcgggacctgggacaaacggggctacatagnnnnnnnnnnnnnnnnn

SEQ ID NO: 143559 - DNA, 433 bp, Homo sapiens
  misc_feature: GYAE6OF01DKDA4.37.17.B06.1.454.CMB.1.raw
  modified_base (381)..(381): a, c, t, g, unknown or other
  misc_feature (381)..(381): n is a, c, g, or t
  modified_base (412)..(412): a, c, t, g, unknown or other
  misc_feature (412)..(412): n is a, c, g, or t
  modified_base (415)..(433): a, c, t, g, unknown or other
  misc_feature (415)..(433): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggcctatattattgtgacgaaagtggtggggggagtggggctactccgtggtcgttttgactacgtcggggccagggacgccctggtccaccgtctcctcacgcctaccgaacgaacgggtcccagttccggtacccttcccccgtggcccgtccctgcctaccgagggacgccacctccggaggagccaacgcggccggtcccgtgggctcgccgttggacaacggtacctaccgttaccatcctaacacttacgnggacggcgggtctaggaccgaaggcaagtanagnnnnnnnnnnnnnnnnnnn

SEQ ID NO: 143560 - DNA, 634 bp, Homo sapiens
  misc_feature: GYAE6OF01CJDKA.37.17.B06.1.454.CMB.1.raw
  modified_base (244)..(244): a, c, t, g, unknown or other
  misc_feature (244)..(244): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
tcagtagtgtagatcacgaccggtgctcgatttagtcgatagtgaagggccgtgttcaccatctccagagactagttccaagagcaactctgtaatcgtcgacaaatgaacagccgtgagtgcgaggacacggcctatacttagttgtgacgtaaagtgggtagggggaggtcggggactacgtccgtaggtcgttttgacctacggtggggccgagggcgtcccgtggccgaccgtctcctanaccgtcctccgaacgacggcctagttccgtaccgttccccgtaggtaccgtccgtgtaccgttacgagtacgaccaccgtaccggaagacgtaccacgacgccggccggtggactcggtaccgtaggtaacgtaacgtaccttactacgataccgtacacgtacgtggacggccggtacgtacggacgaacggcgtacgtaacgtagctctcgagtcncaancgagactcgatcacgcacgntaccgataacgtnacgtacngtaacnctacncgtnacgtacactacgtcgtacgtacgacgtgtaccgtagacgtacgacgtccgtacgatacgtaacgtacgtagacgtacgacgtcgtacgtaacgtactactcgtacgtcgtacg

SEQ ID NO: 143561 - DNA, 394 bp, Homo sapiens
  misc_feature: GYAE6OF01DUCJP.37.17.B06.1.454.CMB.1.raw
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (376)..(394): a, c, t, g, unknown or other
  misc_feature (376)..(394): n is a, c, g, or t
tcagtagtgtagatcacgaccggtgctcgatttagtcgatagtgaagggccgcttcaccatctccagagactattccaagaacacactctatctgcaaatgaacagcctgagaactgaggacacggctgtgtatcactgtgcgaaccgaagggggtttggagatgcagctggagggtgattggtttttgatttagtggggccaaaggggacaatggtcaccgtctcttcagcctccaccgaagggcccatcggtccttcccccnggccacccctccctccaaagacgaccacctcgnggggcacagccggcctgggctgcctggtcaaggactactcatactacactactgagcgggctggacaaggcgcaatagnnnnnnnnnnnnnnnnnnn

SEQ ID NO: 143562 - DNA, 606 bp, Homo sapiens
  misc_feature: GYAE6OF01A22TQ.37.17.B06.1.454.CMB.1.raw
  modified_base (263)..(263): a, c, t, g, unknown or other
  misc_feature (263)..(263): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
  modified_base (588)..(588): a, c, t, g, unknown or other
  misc_feature (588)..(588): n is a, c, g, or t
tcagtagtgtagatcacgaccggtgctcgatttagtcgatagtgaagggccgcttcaccgatctccagagactattccaagagcactctgtatctgcgaaatgaacagcctgagtgccgaggacacggccctatatattgtgcgaaatggtggggggacgtgggggctactcctggactttttgacttacgtggggccagggcgccctggtcaccgtctccctccgcctccaccgaacgggcccatcggtcttccccctggcnccctgctccaggcgcacctccgagtagcaacaggccggacccctgggccttgcccgtagggtaccaaagggttcctaacctttacccaacgtttaccaaccgtaaccgttaaccgtttggggaacggtccgggggtccttacggggaccaaacggggtccggacctaagtaacggncgngacncgatcacgctncgngtacnctcagtatgtacgcgatactnacnctactanacnctcgtatanagactacgacgactactactacgtacgtacgtacgcgtagtccgacgacgtacgccgcgacgcgactactacgtactacncgtcgtccgtccgtaccg

SEQ ID NO: 143563 - DNA, 524 bp, Homo sapiens
  misc_feature: GYAE6OF01CJRFZ.37.17.B06.1.454.CMB.1.raw
  modified_base (245)..(245): a, c, t, g, unknown or other
  misc_feature (245)..(245): n is a, c, g, or t
  modified_base (484)..(524): a, c, t, g, unknown or other
  misc_feature (484)..(524): n is a, c, g, or t
tcagtagtgtagatcacgaccggtgctcgatttagtcgatagtgaagggccgcttcaccatctccagagactattccaagagcactctgtatctgacaaatgaacagcctgagtcgaccgaggacgaccggcctattatttattgtgaacgaaaggtgggtaggggggagggtcggggactcttcgtggtcgttttcgacgtacggtcggggccgaagggcgtcccgtggtccaccgtccttccncgacgaccctacccgaaccggaaaccgggtccctacggttcccggttcccgttcccccggtaggccccgtccgtacgtcccgacgaggaccaccctaccgacgagaccgacgaaccgcgggtcccgccggttggcctacggtccgtaccggttacaaccggtaccttaccttccaaactcctaagaacccctttaggcggtccggacggtcggacgacggaaacggcctatgacgcagnnnnnnnnnnnnnnnnnnnnnnnnnnnnnnnnnnnnnnnnn

SEQ ID NO: 143564 - DNA, 599 bp, Homo sapiens
  misc_feature: GYAE6OF01CQ1ZR.37.17.B06.1.454.CMB.1.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
  modified_base (331)..(331): a, c, t, g, unknown or other
  misc_feature (331)..(331): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (462)..(462): a, c, t, g, unknown or other
  misc_feature (462)..(462): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (491)..(491): a, c, t, g, unknown or other
  misc_feature (491)..(491): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
tcagtagtgtagatcacgaccggtgctcgatttagtcgatagtgaagggccgcttcaccatctccagagactatcaagagcactctgtatctgacaaatcgaacagcctgagtgccgaggacacggcctatattagttgtagacgtaaagtgggtggggggagtggggctacgtccgtggtcgtttgactacgngggcagggcgtccctggtccaccgtctccgtacagaccctacacgaacgggcctagtaccggtcctacccgtgacctaccctcgacaacggtnacccgaacctcgggtaggggacctaacgacggcccggtacccgngggtactacgacggtacggacgaaaacgtccttacgtacacttacgaaccattacgtggacggcggtctagggacaacggcgtanaaggttacgntacgngtacgantcgagcgacttgggaactgaagcncggttancgtntacgtanacggactgganccgagactacgtcagacgtanacgtnagaacgtcgatcgtataccgcattaccgataggacctatagaactacgacttgacgtaacgatacagacgtacgagtagacg

SEQ ID NO: 143565 - DNA, 538 bp, Homo sapiens
  misc_feature: GYAE6OF01BTWRH.37.17.B06.1.454.CMB.1.raw
  modified_base (141)..(141): a, c, t, g, unknown or other
  misc_feature (141)..(141): n is a, c, g, or t
  modified_base (143)..(143): a, c, t, g, unknown or other
  misc_feature (143)..(143): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(538): a, c, t, g, unknown or other
  misc_feature (492)..(538): n is a, c, g, or t
tcagtagtgtagatcacgaccggtgctcgatttagtcgatagtgaagggccgcttcaccatctccagagactattccaagagcactctgtatctgcaaatgaacagcctgagtgccgaaggacacggccctatattattgngngaaatgggtggggggagtggggctactccgtggtcgttttgactaggtggggccaggggactcccgtggtcaccgtctcctcacgcctaccgaaccacgggcccattcccggtcccttcccccgtggcccgtccccgcgtccgtacccgacggtacctacccgtaacccgtaccggaaggaccgaccgtaaccggccgggtccccggtcccgggtcggtccgtaccggtcccggttacggtaacccggtaaccggtaacctttacccttacctaacttaccgtaactaccgttacggtacggacgggtccgggtcgtacgggacggaacggacaacgtaagngcntnannnnnnnnnnnnnnnnnnnnnnnnnnnnnnnnnnnnnnnnnnnnnnn

SEQ ID NO: 143566 - DNA, 542 bp, Homo sapiens
  misc_feature: GYAE6OF01ESTHR.37.17.B06.1.454.CMB.1.raw
  modified_base (152)..(152): a, c, t, g, unknown or other
  misc_feature (152)..(152): n is a, c, g, or t
  modified_base (452)..(452): a, c, t, g, unknown or other
  misc_feature (452)..(452): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
  modified_base (492)..(505): a, c, t, g, unknown or other
  misc_feature (492)..(505): n is a, c, g, or t
  modified_base (507)..(542): a, c, t, g, unknown or other
  misc_feature (507)..(542): n is a, c, g, or t
tcagtagtgtagatcacgaccggtgctcgattttagtcgatagtgaagggccggcttcaccatctccagagactattccaagagcactctgtatctgcaaatgaacagcctgagtgccgaggacaccggcctatattattgtgcgaaatggnggggggagtgggggctactcgtggtcgttttgactacggtggggccgagggacgtcccgtagggtcctacccgtcctcctcgacggtccctacccgaccgaaagggccctagtaccgggtccctttcccccagggtcccgtccccgttcgccttaccgaagggacaccgtaacccgtacccggaggacgtccaaccgaccgggccggccccggtgggaccttcggtccggttacgggtacgaaacggtccctacgtttacccacgttaccttaacgcttaccgtcggacgggtccgggtnaggacgtaaggcgtcnggtancgtnacngctgcttaagcnnnnnnnnnnnnnntnnnnnnnnnnnnnnnnnnnnnnnnnnnnnnnnnnnn

SEQ ID NO: 143567 - DNA, 361 bp, Homo sapiens
  misc_feature: GYAE6OF02FW8UW.37.17.B06.1.454.CMB.1.raw
  modified_base (352)..(361): a, c, t, g, unknown or other
  misc_feature (352)..(361): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctcaccaagggcccatcggtcttccccctggcaccctcctccaagagcacctctggggacacagcggccctgggctgcctggtcaaggactacttccatctacactactgagcgggctggcaaggcgcatagnnnnnnnnnn

SEQ ID NO: 143568 - DNA, 359 bp, Homo sapiens
  misc_feature: GYAE6OF02GR60E.37.17.B06.1.454.CMB.1.raw
  modified_base (359)..(359): a, c, t, g, unknown or other
  misc_feature (359)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattactgtacgaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccatctacactactgagcgggctggcaaggcgcatagn

SEQ ID NO: 143569 - DNA, 360 bp, Homo sapiens
  misc_feature: GYAE6OF02HUKMF.37.17.B06.1.454.CMB.1.raw
  modified_base (357)..(360): a, c, t, g, unknown or other
  misc_feature (357)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggcccctgggctgccctggtcaagggactacttccatctacactactgagcgggctggcaaggcgcatagnnnn

SEQ ID NO: 143570 - DNA, 355 bp, Homo sapiens; identical to SEQ ID NO: 143429
  misc_feature: GYAE6OF02GM02N.37.17.B06.1.454.CMB.1.raw
  modified_base (353)..(355): a, c, t, g, unknown or other
  misc_feature (353)..(355): n is a, c, g, or t

SEQ ID NO: 143571 - DNA, 378 bp, Homo sapiens
  misc_feature: GYAE6OF02GCI24.37.17.B06.1.454.CMB.1.raw
  modified_base (358)..(378): a, c, t, g, unknown or other
  misc_feature (358)..(378): n is a, c, g, or t
tcagtagtgtagatcacgaccggtgctcgatttagtcgatagtgaagggccggacgttcaccatctccagagactattccaagagcactcctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacgttccatctacactactgacgcgggctggcaaggcgcatagnnnnnnnnnnnnnnnnnnnnn

SEQ ID NO: 143572 - DNA, 380 bp, Homo sapiens
  misc_feature: GYAE6OF02FHONX.37.17.B06.1.454.CMB.1.raw
  modified_base (275)..(275): a, c, t, g, unknown or other
  misc_feature (275)..(275): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
  modified_base (360)..(380): a, c, t, g, unknown or other
  misc_feature (360)..(380): n is a, c, g, or t
tcagtagtgtagatcacgaccggtgctcgatttagtcgatagtgaagggccggcttcaccatctcccacgaggtacctattccaagagctactctgtatctgcaaatgaacagcctgagtgccgaggacacggccctatattattgtgtcgaaatgtgggggagttgggggctactcctggcgtttgactactggggccagggagccctggtcgaccgtctcctcagcctccgaccaagggcccatcggtcttcccctggcgccctgctccaggncacctccgagagcacagcggccctgggctgcctggtcaaggactacttccatctacnctactgagcgggctggcaggcncatagnnnnnnnnnnnnnnnnnnnnn

SEQ ID NO: 143573 - DNA, 356 bp, Homo sapiens
  misc_feature: GYAE6OF02IMAIT.37.17.B06.1.454.CMB.1.raw
  modified_base (352)..(356): a, c, t, g, unknown or other
  misc_feature (352)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggcctgggctgcctggtcaaggactacttccatctacactactgagcgggctggcaaggcgcatagnnnnn

SEQ ID NO: 143574 - DNA, 514 bp, Homo sapiens
  misc_feature: GYAE6OF02FT2MF.37.17.B06.1.454.CMB.1.raw
  modified_base (397)..(397): a, c, t, g, unknown or other
  misc_feature (397)..(397): n is a, c, g, or t
  modified_base (399)..(400): a, c, t, g, unknown or other
  misc_feature (399)..(400): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (432)..(433): a, c, t, g, unknown or other
  misc_feature (432)..(433): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (481)..(481): a, c, t, g, unknown or other
  misc_feature (481)..(481): n is a, c, g, or t
  modified_base (509)..(509): a, c, t, g, unknown or other
  misc_feature (509)..(509): n is a, c, g, or t
  modified_base (512)..(514): a, c, t, g, unknown or other
  misc_feature (512)..(514): n is a, c, g, or t
tcagtagtgtagatcacgaccggtgctcgatttagtcgatagtgaaggccgggccttcaccatctccagagactattccaagagcacttctcgttatactgtacaaatgaacaggccctcgagtcgcccgagggaacggacggcccgtatagttagttcgtgcgaaattacgtagggggagtgggggctacgtaacctggcgttttgacgtactggggccagggaggcccgtggtcaccgtctcctcagcctccaaccacggaccaatcggcttcccctggcgccctgcctcaggacgccacgtccgagagcacagcgcctggctgctggcaaggcacctccatcgacactacgtggagcggactggtcaaggcgcggactaggactgcacgtctcncnncncncacgcncncnctccncgcnccncncacnncncncgngcncncgcgcgcgcgcgcgcgcgacgactactcgcgtcgcncgcgtcgcgcggcgcgcgacgcgacganagnnn

SEQ ID NO: 143575 - DNA, 375 bp, Homo sapiens
  misc_feature: GYAE6OF02GWOT2.37.17.B06.1.454.CMB.1.raw
  modified_base (358)..(375): a, c, t, g, unknown or other
  misc_feature (358)..(375): n is a, c, g, or t
tcagtagtgtagatcacgaccggtgctcgatttagtcgatagtgaagggccgcttacaccatctccagagactattccaagagcactctgtatctgcaaatgaacagcctgagttgccgaggacacggccctatattattgtgcgaaatgtggggggagtgggggctactcctggcgttttgactactggggccaggggagccctggtcaccgtctcctcagcctccaccaagggcccatcggtcttccccctggccgccctgctccaggagcacctccgagagcacagcggccctgggctgcctggtcaaggactacttccatctacactactgagcgggctggcaaggcgcatagnnnnnnnnnnnnnnnnnn

SEQ ID NO: 143576 - DNA, 360 bp, Homo sapiens
  misc_feature: GYAE6OF02IJ04M.37.17.B06.1.454.CMB.1.raw
  modified_base (356)..(360): a, c, t, g, unknown or other
  misc_feature (356)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcaccctccgagagcacagcggccctgggctgcctggtcaaggactacttccatctacactactgagcggggctggcaaggcgcatagnnnnn

SEQ ID NO: 143577 - DNA, 394 bp, Homo sapiens
  misc_feature: GYAE6OF02JG24E.37.17.B06.1.454.CMB.1.raw
  modified_base (382)..(383): a, c, t, g, unknown or other
  misc_feature (382)..(383): n is a, c, g, or t
  modified_base (385)..(394): a, c, t, g, unknown or other
  misc_feature (385)..(394): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggaagtgggggctacgtcctggcgttttgactacgtgggggccaggggagcccttgggtccaccggtctcctcagcctccaccaagggcccctaatccggtcttccccctgggccgcccctggcctacccaggacgccacctccgagacgcacagcggtccctgggctgcctggtcaaggacctactccatcctacactactgacgcgggctgggcaaggcgcatagnntnnnnnnnnnn

SEQ ID NO: 143578 - DNA, 354 bp, Homo sapiens
  misc_feature: GYAE6OF02GGR3M.37.17.B06.1.454.CMB.1.raw
  modified_base (352)..(354): a, c, t, g, unknown or other
  misc_feature (352)..(354): n is a, c, g, or t
tcagtagtgtagatcacgaccggtgctcgatttagtcgatagtgaagggccgcttcaccatctccagagactattccaaggagcactctgtatctgcaaatgaacagcctgagtgccgaggacacggcctatattattgtgcgaaatggtgggggagtggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 143579 - DNA, 355 bp, Homo sapiens
  misc_feature: GYAE6OF02IK0KT.37.17.B06.1.454.CMB.1.raw
  modified_base (353)..(355): a, c, t, g, unknown or other
  misc_feature (353)..(355): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcggctggcaaggcgcatagnnn

SEQ ID NO: 143580 - DNA, 355 bp, Homo sapiens
  misc_feature: GYAE6OF02IMA9G.37.17.B06.1.454.CMB.1.raw
  modified_base (352)..(355): a, c, t, g, unknown or other
  misc_feature (352)..(355): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgcctgctccaggagcacctccgagagcacagcggccctgggctgcctggtcaaggactacttccatctacactactgagcgggctggcaaggcgcatagnnnn

SEQ ID NO: 143581 - DNA, 356 bp, Homo sapiens
  misc_feature: GYAE6OF02GYMM9.37.17.B06.1.454.CMB.1.raw
  modified_base (354)..(356): a, c, t, g, unknown or other
  misc_feature (354)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgccctggtcaaggactacttccatctacactactgagcggctggcaaggcgcatagnnn

SEQ ID NO: 143582 - DNA, 356 bp, Homo sapiens
  misc_feature: GYAE6OF02GP25A.37.17.B06.1.454.CMB.1.raw
  modified_base (353)..(356): a, c, t, g, unknown or other
  misc_feature (353)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnn

SEQ ID NO: 143583 - DNA, 357 bp, Homo sapiens
  misc_feature: GYAE6OF02HFKZI.37.17.B06.1.454.CMB.1.raw
  modified_base (354)..(357): a, c, t, g, unknown or other
  misc_feature (354)..(357): n is a, c, g, or t
tcagtagtgtagatcacgaccggtgctcgatttagtcgatagtgaagggccgcttcaccatctccagagactattccaagagcactctgtatctgcaaatgaacaccctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnn

SEQ ID NO: 143584 - DNA, 356 bp, Homo sapiens
  misc_feature: GYAE6OF02FX502.37.17.B06.1.454.CMB.1.raw
  modified_base (354)..(356): a, c, t, g, unknown or other
  misc_feature (354)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggccccatcggtcttcccctggcgccctgctccaggagcacctccgagagcacagcggccctgggctgcctggtcaaggactacttccatctacactactgagcgggctggcaaggcgcatagnnn

SEQ ID NO: 143585 - DNA, 360 bp, Homo sapiens; identical to SEQ ID NO: 143499
  misc_feature: GYAE6OF02HPPP4.37.17.B06.1.454.CMB.1.raw
  modified_base (354)..(360): a, c, t, g, unknown or other
  misc_feature (354)..(360): n is a, c, g, or t

SEQ ID NO: 143586 - DNA, 357 bp, Homo sapiens
  misc_feature: GYAE6OF02IKFDS.37.17.B06.1.454.CMB.1.raw
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactactccatctacactactgagcgggctggcaaggcgcatagnnnnn

SEQ ID NO: 143587 - DNA, 357 bp, Homo sapiens
  misc_feature: GYAE6OF02FYUS1.37.17.B06.1.454.CMB.1.raw
  modified_base (352)..(357): a, c, t, g, unknown or other
  misc_feature (352)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttcccctggcgcccctgctccaggagcacctccgagagcacagcggccctgggctgcctggtcaaggactactccatctacactactgagcgggctggcaaggcgcatagnnnnnn

SEQ ID NO: 143588 - DNA, 359 bp, Homo sapiens; identical to SEQ ID NO: 143445
  misc_feature: GYAE6OF02HK2NQ.37.17.B06.1.454.CMB.1.raw
  modified_base (354)..(359): a, c, t, g, unknown or other
  misc_feature (354)..(359): n is a, c, g, or t

SEQ ID NO: 143589 - DNA, 356 bp, Homo sapiens; identical to SEQ ID NO: 143427
  misc_feature: GYAE6OF02FVJCF.37.17.B06.1.454.CMB.1.raw
  modified_base (351)..(356): a, c, t, g, unknown or other
  misc_feature (351)..(356): n is a, c, g, or t

SEQ ID NO: 143590 - DNA, 356 bp, Homo sapiens
  misc_feature: GYAE6OF02GZ67U.37.17.B06.1.454.CMB.1.raw
  modified_base (353)..(356): a, c, t, g, unknown or other
  misc_feature (353)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnn

SEQ ID NO: 143591 - DNA, 355 bp, Homo sapiens
  misc_feature: GYAE6OF02FJRYG.37.17.B06.1.454.CMB.1.raw
  modified_base (352)..(355): a, c, t, g, unknown or other
  misc_feature (352)..(355): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggagtgggggctactcctgacgttttgactactggggccagggagccctggtcaccgtctcctcagcctccaccaagggcccatcggtcttcccctggcgccctgctccaggagcacctccgagagcacagcggccctgggctgcctggtcaaggactatttccatctacactactgagcgggctggcaaggcgcatagnnnn

SEQ ID NO: 143592 - DNA, 357 bp, Homo sapiens
  misc_feature: GYAE6OF02GMB7V.37.17.B06.1.454.CMB.1.raw
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcggctggcaaggcgcatagnnnnn

SEQ ID NO: 143593 - DNA, 358 bp, Homo sapiens; identical to SEQ ID NO: 143460
  misc_feature: GYAE6OF02GGHV1.37.17.B06.1.454.CMB.1.raw
  modified_base (353)..(358): a, c, t, g, unknown or other
  misc_feature (353)..(358): n is a, c, g, or t

SEQ ID NO: 143594 - DNA, 356 bp, Homo sapiens
  misc_feature: GYAE6OF02JD8FS.37.17.B06.1.454.CMB.1.raw
  modified_base (352)..(356): a, c, t, g, unknown or other
  misc_feature (352)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnn

SEQ ID NO: 143595 - DNA, 378 bp, Homo sapiens
  misc_feature: GYAE6OF02FZJTT.37.17.B06.1.454.CMB.1.raw
  modified_base (376)..(378): a, c, t, g, unknown or other
  misc_feature (376)..(378): n is a, c, g, or t
tcagtagtgtagatcacgaccggtgctcgatttagtcgatagtgaagggccgcttcaccatctccagagactattccaagagcactctgtatctgcatatggacagcctgagagccgacgacgcggctctatattactgtgcgagatggacggcggtggctggtgactcggtcgactcttacgactactatcgcttcatggacgtctggggcaaagggaccacggtcaccgtctcctccgcctccaccaagggcccatcggtcttccccctggcacccctcctccaagagcacctctgggggcacagcggccctgggctgcctggtcaaggactacttccatctacactactgagcgggctggcaaggcgcatagnnn

SEQ ID NO: 143596 - DNA, 359 bp, Homo sapiens; identical to SEQ ID NO: 143445
  misc_feature: GYAE6OF02G4A92.37.17.B06.1.454.CMB.1.raw
  modified_base (354)..(359): a, c, t, g, unknown or other
  misc_feature (354)..(359): n is a, c, g, or t

SEQ ID NO: 143597 - DNA, 358 bp, Homo sapiens
  misc_feature: GYAE6OF02F5WAU.37.17.B06.1.454.CMB.1.raw
  modified_base (347)..(347): a, c, t, g, unknown or other
  misc_feature (347)..(347): n is a, c, g, or t
  modified_base (353)..(358): a, c, t, g, unknown or other
  misc_feature (353)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactactccatctacactactgagcgggctggcaaggcncatagnnnnnn

SEQ ID NO: 143598 - DNA, 369 bp, Homo sapiens
  misc_feature: GYAE6OF02I9DNQ.37.17.B06.1.454.CMB.1.raw
  modified_base (361)..(369): a, c, t, g, unknown or other
  misc_feature (361)..(369): n is a, c, g, or t
tcagtagtgtagatcacgaccggtgctcgatttagtcgatagtgaagggccgcttcaccatctccagagactattccaagagcactctgtatctgacaaatgaacagcctgagtgccgaggacacggccctatattattgtgcgaaatggtggggggagtgggggctactcctggtcgtttgactacgtggggccagggagccctggtcaccgtctcctcagcctccaccaacgggcccatcggtccttcccctggccgccctgcctccaggagccacctccgagagcacagccggcctgggctgcctggtcaaggactacttccatcacactactgagcgggctggacaaggcgcatagnnnnnnnnn

SEQ ID NO: 143599 - DNA, 356 bp, Homo sapiens
  misc_feature: GYAE6OF02HTOTP.37.17.B06.1.454.CMB.1.raw
  modified_base (353)..(356): a, c, t, g, unknown or other
  misc_feature (353)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcggctggcaaggcgcatagnnnn

SEQ ID NO: 143600 - DNA, 375 bp, Homo sapiens
  misc_feature: GYAE6OF02GURHV.37.17.B06.1.454.CMB.1.raw
  modified_base (335)..(335): a, c, t, g, unknown or other
  misc_feature (335)..(335): n is a, c, g, or t
  modified_base (362)..(375): a, c, t, g, unknown or other
  misc_feature (362)..(375): n is a, c, g, or t
tcagtagtgtagatcacgaccggtgctcgatttagtcgatagtgaagggccggcttcaccatctccagagactattccaagagcactctgtatctgcaaatgaacagccctgagtgcccgaggacacggccctatattattgtgcgaaatgtgggggagtgggggctactcctggcgttttgactactggggccaggggagccctggtcaccgtctcctcagcctccaccaagggcccatcggtcttccccctggccgccctgctccaggagcacctccgagagcacagcggccctgggctgcctggtccaaggactacttccatctacactacngagcggggctggccaaggtcgcatagnnnnnnnnnnnnnn

SEQ ID NO: 143601 - DNA, 362 bp, Homo sapiens
  misc_feature: GYAE6OF02HBFTS.37.17.B06.1.454.CMB.1.raw
  modified_base (354)..(362): a, c, t, g, unknown or other
  misc_feature (354)..(362): n is a, c, g, or t
tcagtagtgtagatcacgaccggtgctcgatttagtcgatagtgaagggccggcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctcgagagcacagcggccctgggctgcctggtcaaggctacgttccatctacactactgagcgggctggcaaggcgcatagnnnnnnnnn

SEQ ID NO: 143602 - DNA, 365 bp, Homo sapiens
  misc_feature: GYAE6OF02I098N.37.17.B06.1.454.CMB.1.raw
  modified_base (355)..(365): a, c, t, g, unknown or other
  misc_feature (355)..(365): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggccgccctgctccaggagcacctccgagagcacagccggccctgggctgcctggtcaaggctacttccatctacactactgagcgggctggcaaggcgcatagnnnnnnnnnnn

SEQ ID NO: 143603 - DNA, 365 bp, Homo sapiens
  misc_feature: GYAE6OF02I7ODC.37.17.B06.1.454.CMB.1.raw
  modified_base (357)..(365): a, c, t, g, unknown or other
  misc_feature (357)..(365): n is a, c, g, or t
tcagtagtgtagatcacgaccggtgctcgatttagtcgatagtgaagggccgcttcaccatctccagagacctattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgcccctgctcccaggagcacctccgagagcaccagcggccctggggctgcctggtcaaggctacttccatctacactactgagcgggctggcaaggcgcatgnnnnnnnnn

SEQ ID NO: 143604 - DNA, 359 bp, Homo sapiens
  misc_feature: GYAE6OF02GPV3D.37.17.B06.1.454.CMB.1.raw
  modified_base (352)..(359): a, c, t, g, unknown or other
  misc_feature (352)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggactacttccatctacactactgagcggctggcaaggcgcatagnnnnnnnn

SEQ ID NO: 143605 - DNA, 357 bp, Homo sapiens
  misc_feature: GYAE6OF02I8CDK.37.17.B06.1.454.CMB.1.raw
  modified_base (352)..(357): a, c, t, g, unknown or other
  misc_feature (352)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnn

SEQ ID NO: 143606 - DNA, 356 bp, Homo sapiens; identical to SEQ ID NO: 143427
  misc_feature: GYAE6OF02FT5A9.37.17.B06.1.454.CMB.1.raw
  modified_base (351)..(356): a, c, t, g, unknown or other
  misc_feature (351)..(356): n is a, c, g, or t

SEQ ID NO: 143607 - DNA, 356 bp, Homo sapiens
  misc_feature: GYAE6OF02GOY0Q.37.17.B06.1.454.CMB.1.raw
  modified_base (352)..(356): a, c, t, g, unknown or other
  misc_feature (352)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatctacactactgagcggctggcaaggcgcatagnnnnn

SEQ ID NO: 143608 - DNA, 363 bp, Homo sapiens
  misc_feature: GYAE6OF02IIHBM.37.17.B06.1.454.CMB.1.raw
  modified_base (357)..(363): a, c, t, g, unknown or other
  misc_feature (357)..(363): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctcggctgcctggtcaaggactacttccatctacacactttttttgagcggctggcaggcgcatagnnnnnnn

SEQ ID NO: 143609 - DNA, 361 bp, Homo sapiens
  misc_feature: GYAE6OF02I63HE.37.17.B06.1.454.CMB.1.raw
  modified_base (355)..(361): a, c, t, g, unknown or other
  misc_feature (355)..(361): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgccctggtcaaggactacttccatctacactactgagcgggctggcaaggcgcatagnnnnnnn

SEQ ID NO: 143610 - DNA, 363 bp, Homo sapiens
  misc_feature: GYAE6OF02HD935.37.17.B06.1.454.CMB.1.raw
  modified_base (359)..(363): a, c, t, g, unknown or other
  misc_feature (359)..(363): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnn

SEQ ID NO: 143611 - DNA, 356 bp, Homo sapiens
  misc_feature: GYAE6OF02JGIF6.37.17.B06.1.454.CMB.1.raw
  modified_base (354)..(356): a, c, t, g, unknown or other
  misc_feature (354)..(356): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnn

SEQ ID NO: 143612 - DNA, 358 bp, Homo sapiens
  misc_feature: GYAE6OF02GZ9B0.37.17.B06.1.454.CMB.1.raw
  modified_base (351)..(358): a, c, t, g, unknown or other
  misc_feature (351)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggcctgggctgcctggtcaaggactacttccatctacactactgagcggctggcaaggcgcatagnnnnnnnn

SEQ ID NO: 143613 - DNA, 357 bp, Homo sapiens
  misc_feature: GYAE6OF02F3495.37.17.B06.1.454.CMB.1.raw
  modified_base (346)..(346): a, c, t, g, unknown or other
  misc_feature (346)..(346): n is a, c, g, or t
  modified_base (352)..(357): a, c, t, g, unknown or other
  misc_feature (352)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatctacactactgagcggctggcaaggcncatagnnnnnn

SEQ ID NO: 143614 - DNA, 366 bp, Homo sapiens
  misc_feature: GYAE6OF02I7YFJ.37.17.B06.1.454.CMB.1.raw
  modified_base (358)..(366): a, c, t, g, unknown or other
  misc_feature (358)..(366): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggccccatccggtcttccccctggcaccctcctccaagacgcacctctgggggcacagccggccctgggctgccctggtcaaggactacttccatctacactactgagcgggctggcaagcgcatagnnnnnnnnn

SEQ ID NO: 143615 - DNA, 359 bp, Homo sapiens
  misc_feature: GYAE6OF02H4QZ5.37.17.B06.1.454.CMB.1.raw
  modified_base (353)..(359): a, c, t, g, unknown or other
  misc_feature (353)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggaaacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnnn

SEQ ID NO: 143616 - DNA, 388 bp, Homo sapiens
  misc_feature: GYAE6OF02HULI6.37.17.B06.1.454.CMB.1.raw
  modified_base (382)..(388): a, c, t, g, unknown or other
  misc_feature (382)..(388): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcacgcctccaaccgaacgggcccagtcggttcccttcccccgtggccgccctgcctccgaggacgccaccctccggagacgcacaggccggcccgtgggctcgcctggtacaaggactaccttccatcctaacactactggagcgggctgggcaacggcgcatagnnnnnnn

SEQ ID NO: 143617 - DNA, 354 bp, Homo sapiens
  misc_feature: GYAE6OF02FGWB2.37.17.B06.1.454.CMB.1.raw
  modified_base (351)..(354): a, c, t, g, unknown or other
  misc_feature (351)..(354): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggatgggggctactcctggcgttttgactactggggccagggaccctggtcaccgtctcctcagcctccaccaagggcccatcggtccttccccctggccaccctcctccaagagccacctctgggggcacagcggccctgggctgcctgtcaaggctactcatctacactactgagcgggctggcaaggcgcatagnnnn

SEQ ID NO: 143618 - DNA, 354 bp, Homo sapiens
  misc_feature: GYAE6OF02ILI45.37.17.B06.1.454.CMB.1.raw
  modified_base (352)..(354): a, c, t, g, unknown or other
  misc_feature (352)..(354): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatctacactactgagcggctggcaaggcgcatagnnn

SEQ ID NO: 143619 - DNA, 360 bp, Homo sapiens; identical to SEQ ID NO: 143499
  misc_feature: GYAE6OF02HGI43.37.17.B06.1.454.CMB.1.raw
  modified_base (354)..(360): a, c, t, g, unknown or other
  misc_feature (354)..(360): n is a, c, g, or t

SEQ ID NO: 143620 - DNA, 359 bp, Homo sapiens
  misc_feature: GYAE6OF02GZKVM.37.17.B06.1.454.CMB.1.raw
  modified_base (354)..(359): a, c, t, g, unknown or other
  misc_feature (354)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgccctggtcaaggactacttccatctacactactgagcgggctggcaaggcgcatagnnnnnn

SEQ ID NO: 143621 - DNA, 356 bp, Homo sapiens; identical to SEQ ID NO: 143611
  misc_feature: GYAE6OF02F6XM6.37.17.B06.1.454.CMB.1.raw
  modified_base (354)..(356): a, c, t, g, unknown or other
  misc_feature (354)..(356): n is a, c, g, or t

SEQ ID NO: 143622 - DNA, 364 bp, Homo sapiens
  misc_feature: GYAE6OF02HOEGD.37.17.B06.1.454.CMB.1.raw
  modified_base (357)..(364): a, c, t, g, unknown or other
  misc_feature (357)..(364): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttcccctggccgccctgctccaggacgcacctccgagagcacagccggccctgggctgcctggtcaaggactacttccatcctacactactgagcggctggcaaggcgcatagnnnnnnnn

SEQ ID NO: 143623 - DNA, 357 bp, Homo sapiens; identical to SEQ ID NO: 143482
  misc_feature: GYAE6OF02G5C1X.37.17.B06.1.454.CMB.1.raw
  modified_base (353)..(357): a, c, t, g, unknown or other
  misc_feature (353)..(357): n is a, c, g, or t

SEQ ID NO: 143624 - DNA, 359 bp, Homo sapiens; identical to SEQ ID NO: 143445
  misc_feature: GYAE6OF02FHBH0.37.17.B06.1.454.CMB.1.raw
  modified_base (354)..(359): a, c, t, g, unknown or other
  misc_feature (354)..(359): n is a, c, g, or t

SEQ ID NO: 143625 - DNA, 360 bp, Homo sapiens
  misc_feature: GYAE6OF02IESC0.37.17.B06.1.454.CMB.1.raw
  modified_base (355)..(360): a, c, t, g, unknown or other
  misc_feature (355)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggccgccctgctccaggagcacctccgagagcacagcggccctgggctgcctggtcaaggactacttccatctacactactgagcgggctggcaaggcgcatagnnnnnn

SEQ ID NO: 143626 - DNA, 367 bp, Homo sapiens
  misc_feature: GYAE6OF02FEXEW.37.17.B06.1.454.CMB.1.raw
  modified_base (354)..(367): a, c, t, g, unknown or other
  misc_feature (354)..(367): n is a, c, g, or t
tcagtagtgtagatcacgaccggtgctcgatttagtcgatagtgaagggccggcttcaccatctccagagactattccaagagcactctgtatctgcaaatgaacagcctgagtgccgaggacacggccctatatattgtgcgaaatgtggggggagtgggggctactcctggcgttttgactactgggccagggagccctggtcaccgtctcctcagcctccaccaagggccccatcggtcttcccctggccgccctgctccaggagccacctccgagagcacagcggccctgggctgcctggtcaaggctacttccatctacactactgagcgggctggcaaggcgcatagnnnnnnnnnnnnnn

SEQ ID NO: 143627 - DNA, 360 bp, Homo sapiens; identical to SEQ ID NO: 143499
  misc_feature: GYAE6OF02FSOS8.37.17.B06.1.454.CMB.1.raw
  modified_base (354)..(360): a, c, t, g, unknown or other
  misc_feature (354)..(360): n is a, c, g, or t

SEQ ID NO: 143628 - DNA, 385 bp, Homo sapiens
  misc_feature: GYAE6OF02GSC6M.37.17.B06.1.454.CMB.1.raw
  modified_base (367)..(385): a, c, t, g, unknown or other
  misc_feature (367)..(385): n is a, c, g, or t
tcagtagtgtagatcacgaccggtgctcgatttagtcgatagtgaagggccggcttcaccatctccagagactattccaagagcactctgtatctgcaaatgaacagcctgagtgccgaggacacggccctatattattgtgcgaaatgtggggggagtgggggctactcctggcgttttgactactggggccaggggagccctggtcaccgtctcctcagcctccaccaagggccccatcggtccttcccccgtggccgccctgctccgaggagcacctcgagacgcacagcggcctgggctgcctggtcaaggcctacttccatctacactacgtggacgcgggctggaccaaggcgacagtagnnnnnnnnnnnnnnnnnnn

SEQ ID NO: 143629 - DNA, 357 bp, Homo sapiens
  misc_feature: GYAE6OF02G501Y.37.17.B06.1.454.CMB.1.raw
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgtttgactactggggccagggagccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 143630 - DNA, 357 bp, Homo sapiens
  misc_feature: GYAE6OF02HDMYY.37.17.B06.1.454.CMB.1.raw
  modified_base (354)..(357): a, c, t, g, unknown or other
  misc_feature (354)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnn

SEQ ID NO: 143631 - DNA, 371 bp, Homo sapiens
  misc_feature: GYAE6OF02H4KFS.37.17.B06.1.454.CMB.1.raw
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (360)..(371): a, c, t, g, unknown or other
  misc_feature (360)..(371): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtggggggctactcctggcgttttgactactggggccagggagccctggtcaccgtctcctcagcctccaccaagggcccatcggtcttccccctggccgccctgctccaggacgcacctccgagagcacagcggccctgggctgccctggtcaaggctacttccatctacactacngagcggntggacaaggcgtcagtagnnnnnnnnnnnn

SEQ ID NO: 143632 - DNA, 365 bp, Homo sapiens
  misc_feature: GYAE6OF02FZEIV.37.17.B06.1.454.CMB.1.raw
  modified_base (359)..(365): a, c, t, g, unknown or other
  misc_feature (359)..(365): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattactgtacgaaaatggcctacggatatgactactattgggactggtacttcgatctctggggccgtggcaccctggtcactgtctcctcagcctccaccaagggcccatcggtcttccccctggccgccctgctccaggagcacctccgagagcacagcggccctgggctgcctggtcaaggctactccatctacactactgagcgggctggcaaggcgcatagnnnnnnn

SEQ ID NO: 143633 - DNA, 360 bp, Homo sapiens
  misc_feature: GYAE6OF02FTEXS.37.17.B06.1.454.CMB.1.raw
  modified_base (355)..(360): a, c, t, g, unknown or other
  misc_feature (355)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgccctggtcaaggactacttccatctacactactgagcgggctggcaaggcgcatagnnnnnn

SEQ ID NO: 143634 - DNA, 500 bp, Homo sapiens
  misc_feature: GYAE6OF02ICMPP.37.17.B06.1.454.CMB.1.raw
  modified_base (400)..(400): a, c, t, g, unknown or other
  misc_feature (400)..(400): n is a, c, g, or t
  modified_base (403)..(405): a, c, t, g, unknown or other
  misc_feature (403)..(405): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (464)..(465): a, c, t, g, unknown or other
  misc_feature (464)..(465): n is a, c, g, or t
  modified_base (467)..(468): a, c, t, g, unknown or other
  misc_feature (467)..(468): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(500): a, c, t, g, unknown or other
  misc_feature (487)..(500): n is a, c, g, or t
tcagtagtgtagatcacgaccggtgctcgatttagtcgatagtgaagggtccggtcggttcctacccagtcctccagagactattccaagagcactcctgtatctgcgaaaccgtgaacagcctgagtgccgtaggacacggccctaatattattgtgacgaaatgggtggggggagtggggggctactccgtggtcgttttgactacgtggggaccagggagcccctcggtacaccgtctctcagctcaccaggccatcggtctcccgtgcgcctgctcaggacgcgaccgtcgagcgccacacgccggtcccctggggccttcgcccgtaggtaccgaacggtacctacgttccaagtctacactacgtgagcggtctggacgaacggcacagtaggnagnnngngtcgtcgtgagcgatngcgcgcangcgactgctcncgcgcncncncncncncncacnncnngcgcgcgcgngngcngngnnnnnnnnnnnnnn

SEQ ID NO: 143635 - DNA, 424 bp, Homo sapiens
  misc_feature: GYAE6OF02JB3E9.37.17.B06.1.454.CMB.1.raw
  modified_base (399)..(399): a, c, t, g, unknown or other
  misc_feature (399)..(399): n is a, c, g, or t
  modified_base (405)..(407): a, c, t, g, unknown or other
  misc_feature (405)..(407): n is a, c, g, or t
  modified_base (409)..(415): a, c, t, g, unknown or other
  misc_feature (409)..(415): n is a, c, g, or t
  modified_base (417)..(424): a, c, t, g, unknown or other
  misc_feature (417)..(424): n is a, c, g, or t
tcagtagtgtagatcacgaccggtgctcgatttagtcgatagtgaagggccggcgttcgaccatctccagagactattccaagagcactctgtatctgcaaatgaacagcctgagtgccgaggacgacggccctatattattgtgcgaaatggtggggggaggtgggggctacgtccgtggtcgttttgactacgtggggccagggagccctggtcaccggtctccgtcgacgcctaccgaccgaacggggccccagttccgggtccttccccccgtgggcccgtccctcgacctccgaggacgccacctccgagacgccacagtccggccctgggcctcgccgtgggtcaacggactacgtccactctacactactgacgcggctcgggacaaggccntagagnnngnnnnnnnannnnnnnn

SEQ ID NO: 143636 - DNA, 359 bp, Homo sapiens
  misc_feature: GYAE6OF02IS4UD.37.17.B06.1.454.CMB.1.raw
  modified_base (352)..(359): a, c, t, g, unknown or other
  misc_feature (352)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagccggccctgggctgcctggtcaaggctactccatctacactactgagcgggctggcaaggcgcatagnnnnnnnn

SEQ ID NO: 143637 - DNA, 358 bp, Homo sapiens; identical to SEQ ID NO: 143440
  misc_feature: GYAE6OF02HGDZK.37.17.B06.1.454.CMB.1.raw
  modified_base (354)..(358): a, c, t, g, unknown or other
  misc_feature (354)..(358): n is a, c, g, or t

SEQ ID NO: 143638 - DNA, 359 bp, Homo sapiens
  misc_feature: GYAE6OF02IYV8K.37.17.B06.1.454.CMB.1.raw
  modified_base (353)..(359): a, c, t, g, unknown or other
  misc_feature (353)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcggctggcaaggcgcatagnnnnnnn

SEQ ID NO: 143639 - DNA, 366 bp, Homo sapiens
  misc_feature: GYAE6OF02HQ4HQ.37.17.B06.1.454.CMB.1.raw
  modified_base (269)..(269): a, c, t, g, unknown or other
  misc_feature (269)..(269): n is a, c, g, or t
  modified_base (339)..(339): a, c, t, g, unknown or other
  misc_feature (339)..(339): n is a, c, g, or t
  modified_base (356)..(366): a, c, t, g, unknown or other
  misc_feature (356)..(366): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaacgggcccatcggtcttccccctggccgccctgctccaggngcacctccgagagcacagcggccctgggctgcctggtcaaggactacttccatctacactactgagcggntggcaaggcgacatagnnnnnnnnnnn

SEQ ID NO: 143640 - DNA, 362 bp, Homo sapiens
  misc_feature: GYAE6OF02IBXV2.37.17.B06.1.454.CMB.1.raw
  modified_base (355)..(362): a, c, t, g, unknown or other
  misc_feature (355)..(362): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgccctggtcaaggactacttccatctacactactgagcgggctggcaaggcgcatagnnnnnnnn

SEQ ID NO: 143641 - DNA, 369 bp, Homo sapiens
  misc_feature: GYAE6OF02G5XY8.37.17.B06.1.454.CMB.1.raw
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (357)..(369): a, c, t, g, unknown or other
  misc_feature (357)..(369): n is a, c, g, or t
tcagtagtgtagatcacgaccggtgctcgatttagtcgatagtgaagggccggcgttcaccatctccagagactattccaagagcactctgtatctgcaaatgaacagcctggagtgccgaggacacggccctatattattgtgcgaaagtgtggggggagtgggggctactcctggcgttttgactactggggcccagggagccctggtcaccgtctcctcagcctccaccaagggcccatcggtcttcccctggcgccctgctccaggagcaacctccgagagcacagcggccctgggctgcctggtcaaggctacttccatctacnctactgagcgggctggcaaggcncatgnnnnnnnnnnnnn

SEQ ID NO: 143642 - DNA, 358 bp, Homo sapiens
  misc_feature: GYAE6OF02IKV0S.37.17.B06.1.454.CMB.1.raw
  modified_base (268)..(268): a, c, t, g, unknown or other
  misc_feature (268)..(268): n is a, c, g, or t
  modified_base (348)..(348): a, c, t, g, unknown or other
  misc_feature (348)..(348): n is a, c, g, or t
  modified_base (354)..(358): a, c, t, g, unknown or other
  misc_feature (354)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgctactggggccagggagccctggtcaccgtctcctcagcctccaccaagggcccatcggtcttccccctggccgccctgctccaggancacctccgagagcacagccggccctgggctgcctggtcaaggctacttccatctacactactgagcgggctggcaaggcncatagnnnnn

SEQ ID NO: 143643 - DNA, 363 bp, Homo sapiens
  misc_feature: GYAE6OF02JB2C8.37.17.B06.1.454.CMB.1.raw
  modified_base (352)..(363): a, c, t, g, unknown or other
  misc_feature (352)..(363): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnnnnnnnn

SEQ ID NO: 143644 - DNA, 372 bp, Homo sapiens
  misc_feature: GYAE6OF02IYCBQ.37.17.B06.1.454.CMB.1.raw
  modified_base (282)..(282): a, c, t, g, unknown or other
  misc_feature (282)..(282): n is a, c, g, or t
  modified_base (360)..(372): a, c, t, g, unknown or other
  misc_feature (360)..(372): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggcccatcggtccttccccctggccgccctgctccaggagcacctccgagngcacagccggccctgggctgcctggtcaagggactacttccatcctacactactgagcggggctggcaggcgcatagnnnnnnnnnnnnn

SEQ ID NO: 143645 - DNA, 365 bp, Homo sapiens
  misc_feature: GYAE6OF02I82QD.37.17.B06.1.454.CMB.1.raw
  modified_base (356)..(356): a, c, t, g, unknown or other
  misc_feature (356)..(356): n is a, c, g, or t
  modified_base (361)..(365): a, c, t, g, unknown or other
  misc_feature (361)..(365): n is a, c, g, or t
tcagtagtgtagatcacgaccggtgctcgatttagtcgatagtgaagggccgcttcaccatctccagagactattccaagagcacgtctgtatctgcaaatgaacagcctgagtgccgaggacacggccctatattattgtgcgaaatgtggggggacgtgggggcctactcctggcgttttgactactggggccaggggagccctggtcaccgtctcctcagcctccaccaagggcccatcggtcttccccctggcgccctgctccgaggagccacctccgagacgcacacgcggccctgggctgccgtggtcaaggacctacttccatctacactactgagcggctggcaggcncatgnnnnn

SEQ ID NO: 143646 - DNA, 358 bp, Homo sapiens
  misc_feature: GYAE6OF02FY7D3.37.17.B06.1.454.CMB.1.raw
  modified_base (342)..(342): a, c, t, g, unknown or other
  misc_feature (342)..(342): n is a, c, g, or t
  modified_base (348)..(358): a, c, t, g, unknown or other
  misc_feature (348)..(358): n is a, c, g, or t
tcagtagtgtagatcacgaccggtgctcgatttagtcgatagtgaagggccgcttcaccatctccagagactattccaagagcactctgtatctgcaaatgaacagcctgagagccgaggacacggccctctattactgtgcgagagatcagacggagtatagcagcagctctgactactggggccacggaaccctggtcaccgtctcctcagcctccaccaagggcccatcggtccttccccctggcaccctcctccaagagcacctctgggggcacagcggccctgggctgcctggtcaaggactacttccatctacactactgagcggctggcaaggcncatagnnnnnnnnnnn

SEQ ID NO: 143647 - DNA, 358 bp, Homo sapiens
  misc_feature: GYAE6OF02FF6KQ.37.17.B06.1.454.CMB.1.raw
  modified_base (357)..(358): a, c, t, g, unknown or other
  misc_feature (357)..(358): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgcccctgcctccaggagcacctccgagagcacagcggcccctgggctgcctggtcaaggactacttccatctacactactgagcgggctggcaaggcgcatagnn

SEQ ID NO: 143648 - DNA, 364 bp, Homo sapiens
  misc_feature: GYAE6OF02I7WCW.37.17.B06.1.454.CMB.1.raw
  modified_base (353)..(353): a, c, t, g, unknown or other
  misc_feature (353)..(353): n is a, c, g, or t
  modified_base (358)..(364): a, c, t, g, unknown or other
  misc_feature (358)..(364): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggccccatcggtccttccccctggccgccctgcctccaggagccacctccgagagcacagccggccctgggctgcctggtcaaggactacttccatcctacactctgagcggctggcaaggcncatgnnnnnnn

SEQ ID NO: 143649 - DNA, 359 bp, Homo sapiens
  misc_feature: GYAE6OF02F2HYY.37.17.B06.1.454.CMB.1.raw
  modified_base (353)..(359): a, c, t, g, unknown or other
  misc_feature (353)..(359): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnnn

SEQ ID NO: 143650 - DNA, 362 bp, Homo sapiens
  misc_feature: GYAE6OF02HJHOP.37.17.B06.1.454.CMB.1.raw
  modified_base (350)..(350): a, c, t, g, unknown or other
  misc_feature (350)..(350): n is a, c, g, or t
  modified_base (356)..(362): a, c, t, g, unknown or other
  misc_feature (356)..(362): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggccgccctgctccaggagcacctccgagagcacagcggccctgggctgccctggtcaaggactacttccatctacactactgagcgggctggcaaggcncatagnnnnnnn

SEQ ID NO: 143651 - DNA, 365 bp, Homo sapiens
  misc_feature: GYAE6OF02IT5TH.37.17.B06.1.454.CMB.1.raw
  modified_base (352)..(352): a, c, t, g, unknown or other
  misc_feature (352)..(352): n is a, c, g, or t
  modified_base (354)..(365): a, c, t, g, unknown or other
  misc_feature (354)..(365): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggcctgggctgcctggtcaaggactacttccatctacactactgagcggctggcaaggcgcatagnannnnnnnnnnnn

SEQ ID NO: 143652 - DNA, 361 bp, Homo sapiens
  misc_feature: GYAE6OF02IV1KF.37.17.B06.1.454.CMB.1.raw
  modified_base (354)..(361): a, c, t, g, unknown or other
  misc_feature (354)..(361): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttccccctggccgccctgctccaggagcacctccgagagcacagcgccctgggctgcctggtcaaggctacttccatctacactactgagcgggctggcaaggcgcatagnnnnnnnn

SEQ ID NO: 143653 - DNA, 360 bp, Homo sapiens
  misc_feature: GYAE6OF02FNV2C.37.17.B06.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (352)..(360): a, c, t, g, unknown or other
  misc_feature (352)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccacaaggcccatcggtcttccccnggcgccctgctccaggngcacctccgagagcacagcggccctgggctgcctggtcaaggactacttccatctacactactgagcgggctgggcaaggcgcatagnnnnnnnnn

SEQ ID NO: 143654 - DNA, 360 bp, Homo sapiens
  misc_feature: GYAE6OF02HPWWG.37.17.B06.1.454.CMB.1.raw
  modified_base (353)..(360): a, c, t, g, unknown or other
  misc_feature (353)..(360): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggccgccctgctccaggagcacctccgagagcacagcggccctgggctgcctggtcaaggactacttccatctacacactgagcggctggcaaggcgcatagnnnnnnnn

SEQ ID NO: 143655 - DNA, 369 bp, Homo sapiens
  misc_feature: GYAE6OF02IYD1F.37.17.B06.1.454.CMB.1.raw
  modified_base (359)..(369): a, c, t, g, unknown or other
  misc_feature (359)..(369): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtggggggctacgtcctggcgttttgactactggggccagggagccctggtcaccgtctcctcagcctccaccaagggcccatcggtcttcccctggccgccctgctccaggacgcacctccgagacgcacagccggccctgggctgcctggtcaaggtctacttcatctacactactgagcggctggacaaggcgcatagnnnnnnnnnnn

SEQ ID NO: 143656 - DNA, 362 bp, Homo sapiens
  misc_feature: GYAE6OF02HSH50.37.17.B06.1.454.CMB.1.raw
  modified_base (350)..(362): a, c, t, g, unknown or other
  misc_feature (350)..(362): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctcaccaagggcccatcggtcctcccctggccgccctgctcaggagcacctccgagagcacagcggccctgggctggcctggtcaggactacttccatcacactactgagcggctggcaaggcgcatagnnnnnnnnnnnnn

SEQ ID NO: 143657 - DNA, 361 bp, Homo sapiens
  misc_feature: GYAE6OF02FP1XP.37.17.B06.1.454.CMB.1.raw
  modified_base (355)..(361): a, c, t, g, unknown or other
  misc_feature (355)..(361): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggccccatcggtcttccccctggcgccctgctccaggagcacctccgagagcacagcggccctgggctgcctggtcaaggactacttccatctacactactgagcgggctggcaaggcgcatagnnnnnnn

SEQ ID NO: 143658 - DNA, 363 bp, Homo sapiens
  misc_feature: GYAE6OF02I57Z1.37.17.B06.1.454.CMB.1.raw
  modified_base (356)..(363): a, c, t, g, unknown or other
  misc_feature (356)..(363): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtggggggctactcctggcgttttgactactggggccagggagccctggtcaccgtctcctcagcctccaccaagggcccatcggtcttccccctggccgccctgctccaggagccacctccgagagcacagcggccctgggctgcctggtcaaggactactccatctacactactgagcgggctggcaaggcgcatagnnnnnnnn

SEQ ID NO: 143659 - DNA, 361 bp, Homo sapiens
  misc_feature: GYAE6OF02F881Q.37.17.B06.1.454.CMB.1.raw
  modified_base (354)..(361): a, c, t, g, unknown or other
  misc_feature (354)..(361): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnnn

SEQ ID NO: 143660 - DNA, 357 bp, Homo sapiens
  misc_feature: GYAE6OF02HH2ZE.37.17.B06.1.454.CMB.1.raw
  modified_base (347)..(357): a, c, t, g, unknown or other
  misc_feature (347)..(357): n is a, c, g, or t
tcagtagtgtagatcacgaccggtgctcgatttagtcgatagtgaagggccgcttcaccatctccagagactattccaagagcactctgtatctgcaaatgaacagcctgagagccgaggacacggctgtgtattactgtgcgagagccctccacctcagcagcagcggtgacttctggggccagggaaccctggtcaccgtctcctcagcctccaccaagggcccatcggtcttcccctggccaccctcctccaagacgcacctcgtggggcacagccggccctgggcctgcctggtcaaggactactccatctacactactgagcggctggcaaggcgacatagnnnnnnnnnnn

SEQ ID NO: 143661 - DNA, 411 bp, Homo sapiens
  misc_feature: GYAE6OF02I1U3J.37.17.B06.1.454.CMB.1.raw
  modified_base (382)..(411): a, c, t, g, unknown or other
  misc_feature (382)..(411): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggccccatccggtccttccccctggccgcccctgcctccaggacgccacctcccggaagacgtacaggcccggccctggggctcgccctggtccaaggacctaccttccatcctacactactggacgcgggctgggacaacggcacatagcnnnnnnnnnnnnnnnnnnnnnnnnnnnnnn

SEQ ID NO: 143662 - DNA, 409 bp, Homo sapiens
  misc_feature: GYAE6OF02IE59L.37.17.B06.1.454.CMB.1.raw
  modified_base (381)..(409): a, c, t, g, unknown or other
  misc_feature (381)..(409): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccaggggagccctggtcaccgtctcctcagcctccaccgaagggcccatcggtccttcccccgtggccgccctgcctccgaggacgccacctcgagagccacgagccggcccgtgggcctcgcctggtacaaggtacctacttccatcctacactactgaggcgggctgggacaacggcgacaagtagnnnnnnnnnnnnnnnnnnnnnnnnnnnnn

SEQ ID NO: 143663 - DNA, 562 bp, Homo sapiens
  misc_feature: GYAE6OF02JR0JR.37.17.B06.1.454.CMB.1.raw
  modified_base (509)..(509): a, c, t, g, unknown or other
  misc_feature (509)..(509): n is a, c, g, or t
  modified_base (512)..(513): a, c, t, g, unknown or other
  misc_feature (512)..(513): n is a, c, g, or t
  modified_base (516)..(517): a, c, t, g, unknown or other
  misc_feature (516)..(517): n is a, c, g, or t
  modified_base (519)..(522): a, c, t, g, unknown or other
  misc_feature (519)..(522): n is a, c, g, or t
  modified_base (524)..(562): a, c, t, g, unknown or other
  misc_feature (524)..(562): n is a, c, g, or t
tcagtagtgtagatcacgaccggtgctcgatttagtcgatagtgaagggcgcttcaccatctccagagactattccaagagcactctgtatctgcaaatgaacagcctgagtgccgaggacaccggccctatattacttgtgcgaaatggtggggggagtggggggcttactccgtgggtcgttttgaccttacgtgggggccagggggagccccgtgggttccaaccggttcctccctcgacggccccttacccgaaccgaaccggggtccccaagttccggggttcccttccccccgttgggcccggtcccctcgtccgttcccgagggacgtccaacccgttcccggaagcggccacgagggccggtccccgtgggggccttcgggccccttgggtccaaaacgggccttaccggttcccacggttcctaacgtacctaactgggtacgcggggccctgggccgaaacgggtcaccgtatagggctcggacttgactgcgagtccngcnncgnngnnnncnnnnnnnnnnnnnnnnnnnnnnnnnnnnnnnnnnnnnnn

SEQ ID NO: 143664 - DNA, 366 bp, Homo sapiens
  misc_feature: GYAE6OF02FH06E.37.17.B06.1.454.CMB.1.raw
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (363)..(366): a, c, t, g, unknown or other
  misc_feature (363)..(366): n is a, c, g, or t
tcagtagtgtagatcacgaccggtgctcgatttagtcgatagtgaagggccgcttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacnctactgagcgggctggcaaggcncatagnnnn

SEQ ID NO: 143665 - DNA, 374 bp, Homo sapiens
  misc_feature: GYAE6OF02IN3DS.37.17.B06.1.454.CMB.1.raw
  modified_base (360)..(374): a, c, t, g, unknown or other
  misc_feature (360)..(374): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatccggtcttccccctggccgccctgcctccaggacgccaccctccgagagcacagcggccctgggctgcctggtcaaggactacttccatctacactactgaggcggctggcaaggcgcatagnnnnnnnnnnnnnnn

SEQ ID NO: 143666 - DNA, 365 bp, Homo sapiens
  misc_feature: GYAE6OF02IU7HJ.37.17.B06.1.454.CMB.1.raw
  modified_base (349)..(349): a, c, t, g, unknown or other
  misc_feature (349)..(349): n is a, c, g, or t
  modified_base (355)..(365): a, c, t, g, unknown or other
  misc_feature (355)..(365): n is a, c, g, or t
tcagtagtgtagatcacgaccggtgctcgatttagtcgatagtgaagggccgcttcaccatctcgagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttccccctggccgccctgctccgaggagcacctccgagagcacagcggccctgggctgcctggtcaaggctacttccatctacactactgagcggctggcaaggcncatagnnnnnnnnnnn

SEQ ID NO: 143667 - DNA, 379 bp, Homo sapiens
  misc_feature: GYAE6OF02G01C8.37.17.B06.1.454.CMB.1.raw
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
  modified_base (357)..(379): a, c, t, g, unknown or other
  misc_feature (357)..(379): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggggagtgggggctactcctggcgttttgactacgtggggccagggagcccgtggtcaccgtctcctcagcctccaccaagggcccatcggtccttcccccgtggccgccctgcctccaggacgccacctccgagngcacngcgcctgggctgctggcaaggactcttcatctacactatgaggcggctggacaggcncagtagnnnnnnnnnnnnnnnnnnnnnnn

SEQ ID NO: 143668 - DNA, 507 bp, Homo sapiens
  misc_feature: GYAE6OF02H857A.37.17.B06.1.454.CMB.1.raw
  modified_base (295)..(295): a, c, t, g, unknown or other
  misc_feature (295)..(295): n is a, c, g, or t
  modified_base (451)..(452): a, c, t, g, unknown or other
  misc_feature (451)..(452): n is a, c, g, or t
  modified_base (454)..(455): a, c, t, g, unknown or other
  misc_feature (454)..(455): n is a, c, g, or t
  modified_base (457)..(507): a, c, t, g, unknown or other
  misc_feature (457)..(507): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctgggcgtttttgactacgtgggggccaggggacgcccctgggtccaccggtctccctacagcctccaaccgaacgggccccattccgggtccttcccccgtggcccgccctgcctcccaaggcnccaccctcccggagagccaacgacggccggccccgtggggctcggtccccgtggggtaccaaaacgggtaccttaccgtttcccgaacttaccgtaccaacttaccgtggaacgggccgggcgttgggaccgaaacggtccggctaagtacggacnncnnannnnnnnnnnnnnnnnnnnnnnnnnnnnnnnnnnnnnnnnnnnnnnnnnnn

SEQ ID NO: 143669 - DNA, 372 bp, Homo sapiens
  misc_feature: GYAE6OF02HYPF8.37.17.B06.1.454.CMB.1.raw
  modified_base (359)..(359): a, c, t, g, unknown or other
  misc_feature (359)..(359): n is a, c, g, or t
  modified_base (365)..(372): a, c, t, g, unknown or other
  misc_feature (365)..(372): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggcccatcggtccttccccctggccgccctgctccaggagcacctccgagacgcaccagccggccctggggcctgccctggtcgaagggactacttccatcctacactactgagcggctggcaaggcncatagnnnnnnnn

SEQ ID NO: 143670 - DNA, 473 bp, Homo sapiens
  misc_feature: GYAE6OF02JUQ21.37.17.B06.1.454.CMB.1.raw
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (439)..(473): a, c, t, g, unknown or other
  misc_feature (439)..(473): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtggggggctacgtcgtggcgttttgactacgtgggcagggagtccctgggtcaccgtctccgtcagcctccaccgaacgggccccagtccgggtcctccccgtggcccgcctagctacccgnggacgccacctccggagtacnccgtacgacgccgggtcctggggcctcggcccgtggacctaacgggactaaccgttccacgtcctactaacgtccaggtacggccggggtacctggggacaaacgggcctacgtaagtacggctgagcagttcntgngnnnnnnnnnnnnnnnnnnnnnnnnnnnnnnnnnnn

SEQ ID NO: 143671 - DNA, 380 bp, Homo sapiens
  misc_feature: GYAE6OF02HHVW0.37.17.B06.1.454.CMB.1.raw
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
  modified_base (365)..(380): a, c, t, g, unknown or other
  misc_feature (365)..(380): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggatggggggctactctgggcgttttgactacgtggggccaggggagcccctgggtcaacccggtnccgtcagcctcaccgaagggcccatcggtctccccctggccacctgctccaggacnctactccgagacgcacaggccgccctgggctcgcgtgtcaaggctaacgtcatctacgatactgagcgggctggacaagggctcaatggnnnnnnnnnnnnnnnn

SEQ ID NO: 143672 - DNA, 371 bp, Homo sapiens
  misc_feature: GYAE6OF02IGGGU.37.17.B06.1.454.CMB.1.raw
  modified_base (356)..(371): a, c, t, g, unknown or other
  misc_feature (356)..(371): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgtttttgactactggggccagggagccctggtcaccgtctcctcagcctccaccaagggcccatcggtccttccccctggccgccctgctccaggagcacctccgagagcacagcggccctgggctgccctggtcaaggctacttccatctacactactgagcggctggcaaggcgcatagnnnnnnnnnnnnnnnn

SEQ ID NO: 143673 - DNA, 372 bp, Homo sapiens
  misc_feature: GYAE6OF02G5KSU.37.17.B06.1.454.CMB.1.raw
  modified_base (327)..(327): a, c, t, g, unknown or other
  misc_feature (327)..(327): n is a, c, g, or t
  modified_base (357)..(359): a, c, t, g, unknown or other
  misc_feature (357)..(359): n is a, c, g, or t
  modified_base (361)..(372): a, c, t, g, unknown or other
  misc_feature (361)..(372): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggccgccctgcctccaggagccacctccgagagcacagcggccctgggctgcctggtcaaggactactccatctacnctactgagcgggctggcaaggcgacatagnnngnnnnnnnnnnnn

SEQ ID NO: 143674 - DNA, 410 bp, Homo sapiens
  misc_feature: GYAE6OF02HLUHH.37.17.B06.1.454.CMB.1.raw
  modified_base (395)..(410): a, c, t, g, unknown or other
  misc_feature (395)..(410): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgagagatcagacggagtatagcagcagctctgactacgtggggccacggaaccctggtccaccgtctcctcacgcctccaccgaagggcccatccggtccttcccccgtggccaccctccctcaagacgcacctcgtgggggcacgacggccggcccgtgggcctcggtccgttgggtacgaaggtaccttaccttccactcctaacaccttacgtggacgggcgggtctcggacgaacgggcgactactagnnnnnnnnnnnnnnnn

SEQ ID NO: 143675 - DNA, 380 bp, Homo sapiens
  misc_feature: GYAE6OF02GNZDJ.37.17.B06.1.454.CMB.1.raw
  modified_base (354)..(354): a, c, t, g, unknown or other
  misc_feature (354)..(354): n is a, c, g, or t
  modified_base (359)..(360): a, c, t, g, unknown or other
  misc_feature (359)..(360): n is a, c, g, or t
  modified_base (362)..(380): a, c, t, g, unknown or other
  misc_feature (362)..(380): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaacgggcccatccggtcttccccctggccgccctgcctccaggagcacctccgagagcacagcggccctgggcctgcctggtcaacggctactcatctacactactgacgcggctggcaaggccgnagtannannnnnnnnnnnnnnnnnnn

SEQ ID NO: 143676 - DNA, 371 bp, Homo sapiens
  misc_feature: GYAE6OF02H9LKP.37.17.B06.1.454.CMB.1.raw
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (359)..(371): a, c, t, g, unknown or other
  misc_feature (359)..(371): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgtttttgactactggggccaggggagccctggtcaccgtctcctcagcctccaccaagggccccatcggtccttccccctggccgccctgcctccaggacgcacctccgagagcacngcggcctgggctgcctggtcaaggctacttcatctacactacngagcgggctggcaaggcncatagnnnnnnnnnnnnn

SEQ ID NO: 143677 - DNA, 371 bp, Homo sapiens
  misc_feature: GYAE6OF02F0JAH.37.17.B06.1.454.CMB.1.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (352)..(352): a, c, t, g, unknown or other
  misc_feature (352)..(352): n is a, c, g, or t
  modified_base (357)..(371): a, c, t, g, unknown or other
  misc_feature (357)..(371): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacaccggccctatattattgtgcgaaatgtgggggggatggggggctactcctggcgttttgactactggggccagggagccctggtcaccgtctcctcagcctccaccaagggcccatcggtcttcccccnggctccctgctccaggncacctcgagagcacagcggccctgggctgccgtggtccaaggaccttacttccatctacactactgagcgggctggcaaggcncatgnnnnnnnnnnnnnnn

SEQ ID NO: 143678 - DNA, 371 bp, Homo sapiens
  misc_feature: GYAE6OF02IOBRM.37.17.B06.1.454.CMB.1.raw
  modified_base (274)..(274): a, c, t, g, unknown or other
  misc_feature (274)..(274): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (361)..(371): a, c, t, g, unknown or other
  misc_feature (361)..(371): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccagggagccctggtccaccgtctcctcagcctccaccaagggcccatcggtccttcccctggccgccctgctccaggacncacctccgagagcacagccggccctgggctgcctggtcaaggactacttccatctacactacngagcgggntggacaggcgcatagnnnnnnnnnnn

SEQ ID NO: 143679 - DNA, 442 bp, Homo sapiens
  misc_feature: GYAE6OF02JZIUI.37.17.B06.1.454.CMB.1.raw
  modified_base (217)..(217): a, c, t, g, unknown or other
  misc_feature (217)..(217): n is a, c, g, or t
  modified_base (366)..(366): a, c, t, g, unknown or other
  misc_feature (366)..(366): n is a, c, g, or t
  modified_base (389)..(391): a, c, t, g, unknown or other
  misc_feature (389)..(391): n is a, c, g, or t
  modified_base (393)..(394): a, c, t, g, unknown or other
  misc_feature (393)..(394): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (401)..(442): a, c, t, g, unknown or other
  misc_feature (401)..(442): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctnagcctccaccaagggcccatccggtcttcccctggccgccctgcctccgaggacgctacctccggagacgccacgacggccggccctggggctcggccctgggtaccaaagggacctacttccgatccgtacacttactggacgcgggntcggcaacgggcacagtagcagnnnannangnagnnnnnnnnnnnnnnnnnnnnnnnnnnnnnnnnnnnnnnnnnn

SEQ ID NO: 143680 - DNA, 428 bp, Homo sapiens
  misc_feature: GYAE6OF02JZU1K.37.17.B06.1.454.CMB.1.raw
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (389)..(428): a, c, t, g, unknown or other
  misc_feature (389)..(428): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattatgtgcgaaatgtggggggagtggggggctacgtccgtggtcgttttgactacgtggggccaggggagccctggtcaccgtctcctcagcctccaccaagggcccatccggtcttccccctggccgccctgctccgaggagccaccgtccgagacgcacacgccggcccctggggccttcggccctggtccaaaggctaccttccatccgtacactactgacgtcggggctgggccaaggccgacatagnancnnnnnnnnnnnnnnnnnnnnnnnnnnnnnnnnnnnnnnnn

SEQ ID NO: 143681 - DNA, 370 bp, Homo sapiens
  misc_feature: GYAE6OF02F8CXX.37.17.B06.1.454.CMB.1.raw
  modified_base (357)..(357): a, c, t, g, unknown or other
  misc_feature (357)..(357): n is a, c, g, or t
  modified_base (360)..(370): a, c, t, g, unknown or other
  misc_feature (360)..(370): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccaggggagccctggtcaccgtctcctcagccctccaccaagggccccatcggtcttcccccgtggccaccctcctccaagagccacctcgtcgggggcacagcggccctgggctgcctggtcaaggctactccatctacactactgagcgggctggcaaggcgcanagnnnnnnnnnnn

SEQ ID NO: 143682 - DNA, 447 bp, Homo sapiens
  misc_feature: GYAE6OF02HV62V.37.17.B06.1.454.CMB.1.raw
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
  modified_base (417)..(418): a, c, t, g, unknown or other
  misc_feature (417)..(418): n is a, c, g, or t
  modified_base (420)..(447): a, c, t, g, unknown or other
  misc_feature (420)..(447): n is a, c, g, or t
tcagtagtgtagatcacgaccggtgctcgatttagtcgatagtgaagggccgcgttcaccgatctccagagactattcaagagcactctgtatctgctaaatgaacagcctgagtgccgaggacgacggccctatatattgtgcgaaatggtggggggagtgggggctactccgtggtcggttttgactacgtcggggaccgagggacgcccgtggtccaccgttcgtccctacgacgtccctcaaccgtaaacgggccccaacgtccgggtacccttccccccgtggacccgcctcggccttccgaggaaccgcaccccaggaacgagccaacgacgcggtccccgagggtctcgaccgtgtacacgtactacgtccctancgtacactagngaggcggctggcaaggctnaagtnncnnnnnnnnnnnnnnnnnnnnnnnnnnnn

SEQ ID NO: 143683 - DNA, 387 bp, Homo sapiens
  misc_feature: GYAE6OF02G7NBR.37.17.B06.1.454.CMB.1.raw
  modified_base (370)..(370): a, c, t, g, unknown or other
  misc_feature (370)..(370): n is a, c, g, or t
  modified_base (376)..(387): a, c, t, g, unknown or other
  misc_feature (376)..(387): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactacgtggggccagggagccctggtcaccgtctcctcagcctccaccaagggcccatcggtccttccccctggccgccctgcctccgaggacgccaccgtccgagacacaccaggccggccctgggctcgcctggtacaaggtacctactcactactacactactggaggccgggctcgggcaacggcncatagnnnnnnnnnnnn

SEQ ID NO: 143684 - DNA, 625 bp, Homo sapiens
  misc_feature: GYAE6OF02HUJ6X.37.17.B06.1.454.CMB.1.raw
  modified_base (477)..(477): a, c, t, g, unknown or other
  misc_feature (477)..(477): n is a, c, g, or t
  modified_base (500)..(500): a, c, t, g, unknown or other
  misc_feature (500)..(500): n is a, c, g, or t
  modified_base (502)..(503): a, c, t, g, unknown or other
  misc_feature (502)..(503): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (530)..(530): a, c, t, g, unknown or other
  misc_feature (530)..(530): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (570)..(570): a, c, t, g, unknown or other
  misc_feature (570)..(570): n is a, c, g, or t
tcagtagtgtagatcacgaccggtgctcgatttagtcgatagtgaagggccgcttcaccactctccagagactattccaagacgcactctgtatctgacaaatgaacagcctgagtcgccgaggacacggcctatatttagttcgtgcgaattgtgggggagtgggggctacgtctggcgttttgactacgtgggccagggagcccgtggtcaccgtctcctcacgcctccaccgaacgggcccaacgtccggttccttacccccgtgggccgtcccttcgccttccgaacggacgtaccaaccgtccggaacgtacggccaacgtacggccggtcccgtgggggcctacggtaccctacgggtaccgaaaacgggtaaccgttaccgttttccgaacgttacccggtaacctaacgttaaccggtaggtacggtccggggtacttagggaccggaacggtccgacgtaactaaggngacgtcgacgcgagcgtacgcancnncacncacacganactanacacacacanactactacgcgacacncnagacgcgacgtcgagcacgacnagagacgacgacgacgtacgacgatacgtagtactacgtacagacgcgacgtacg

SEQ ID NO: 143685 - DNA, 376 bp, Homo sapiens
  misc_feature: GYAE6OF02FJA6Y.37.17.B06.1.454.CMB.1.raw
  modified_base (362)..(376): a, c, t, g, unknown or other
  misc_feature (362)..(376): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggggagtgggggctactcctggcgttttgactactggggccaggggagccctggtcaccgtctcctcagccctccaccaagggcccatcggtcttccccctggccgcccctgcctccaggagccacctccgagagcacagcggccctgggctgcctggtcaaggcctactccatctacactactgagcgggctggcaaggcgcaagtagnnnnnnnnnnnnnnn

SEQ ID NO: 143686 - DNA, 366 bp, Homo sapiens
  misc_feature: GYAE6OF02GT7Z1.37.17.B06.1.454.CMB.1.raw
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (354)..(366): a, c, t, g, unknown or other
  misc_feature (354)..(366): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtccttcccctggccgccctgtccaggagccacctccgagagcacagccggccctgggctgcctggtcaaggctacttccatctacactatgagcgggntggcaaggcncatagnnnnnnnnnnnnn

SEQ ID NO: 143687 - DNA, 385 bp, Homo sapiens
  misc_feature: GYAE6OF02HV8YY.37.17.B06.1.454.CMB.1.raw
  modified_base (376)..(385): a, c, t, g, unknown or other
  misc_feature (376)..(385): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtgggggggagtgggggctactcctggcgttttgactactggggccagggagccctggtccaccgtctcctcagcctccaccaagggcccatcggtccttccccctggccgccctgctccaggagccacctccgagacgcacacgccggccctggggctcgccctgggtcaacgggacttaccttccatcctacactactgacggcgggctggacaaggccgacatagnnnnnnnnnn

SEQ ID NO: 143688 - DNA, 513 bp, Homo sapiens
  misc_feature: GYAE6OF02IU0ST.37.17.B06.1.454.CMB.1.raw
  modified_base (464)..(464): a, c, t, g, unknown or other
  misc_feature (464)..(464): n is a, c, g, or t
  modified_base (466)..(513): a, c, t, g, unknown or other
  misc_feature (466)..(513): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacgcccctatattattgtgcgaaatggtgggggggagtggggggctactcctggtcgttttgactacgtgggggccaggggacgcccgtgggtccacccgtctccctcacgccctcccaccgaacgggccccagtccgggttcccttcccccgtgggccgcccctgcctcccgagggtcgccctaccgtccggagacgccaaccgacggccgggccccgtggggccttcggcccgttgggtaccgaaagggtaccttaccgtttcccaacgtttcctaacctacttacggtcggaacgggccggggtcgttagggaccgaaacgggtccgactaaagtacgngnnnnnnnnnnnnnnnnnnnnnnnnnnnnnnnnnnnnnnnnnnnnnnnn

SEQ ID NO: 143689 - DNA, 450 bp, Homo sapiens
  misc_feature: GYAE6OF02HOGLJ.37.17.B06.1.454.CMB.1.raw
  modified_base (426)..(427): a, c, t, g, unknown or other
  misc_feature (426)..(427): n is a, c, g, or t
  modified_base (429)..(450): a, c, t, g, unknown or other
  misc_feature (429)..(450): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgacgaaatggtggggggaggtgggggcctactcctggtcgttttgactacgtggggccaggggacgccctggtccaccgtctccctcacgccctccaccgaacgggccccagttccggtcccttcccccgtgggcccgtccctcgcctccgaggcgccaccctccggagacgccaacgaggccggcccgtggggcctcgcccgtgggtacaaacggtcctaccgttccacttcctaacctacctacgtggaccggtccgggtcgtgggacgaacggcgactagagnngnnnnnnnnnnnnnnnnnnnnnn

SEQ ID NO: 143690 - DNA, 469 bp, Homo sapiens
  misc_feature: GYAE6OF02F9B03.37.17.B06.1.454.CMB.1.raw
  modified_base (281)..(281): a, c, t, g, unknown or other
  misc_feature (281)..(281): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (421)..(469): a, c, t, g, unknown or other
  misc_feature (421)..(469): n is a, c, g, or t
tcagtagtgtagatcacgaccggtgctcgatttagtcgatagtgaagggccggcgttcaccatctccagagactattccaagagcactctgtatctgcaaatgaacagcctgagtgccgaggacacggccctatattattgtgcgaaatgtggggggagtgggggctactcctggtcgttttgactacgtggggccaggggagccctggtcaccgtctcctcagcctccaaccaacgggccccatccggtcttccccccgtggccgccctgcctccgaggngccacctccgagtcgcacacgcggccctggggcctgccctggtaccaaaggtaccttaccttccaattccgtacaaccttacgtgacgtccggggctgggaccgtaagggccacgacgttaaggctagngctagnaacgnnnnnnnnnnnnnnnnnnnnnnnnnnnnnnnnnnnnnnnnnnnnnnnnn

SEQ ID NO: 143691 - DNA, 418 bp, Homo sapiens
  misc_feature: GYAE6OF02F0KLU.37.17.B06.1.454.CMB.1.raw
  modified_base (200)..(200): a, c, t, g, unknown or other
  misc_feature (200)..(200): n is a, c, g, or t
  modified_base (253)..(253): a, c, t, g, unknown or other
  misc_feature (253)..(253): n is a, c, g, or t
  modified_base (360)..(360): a, c, t, g, unknown or other
  misc_feature (360)..(360): n is a, c, g, or t
  modified_base (362)..(363): a, c, t, g, unknown or other
  misc_feature (362)..(363): n is a, c, g, or t
  modified_base (365)..(365): a, c, t, g, unknown or other
  misc_feature (365)..(365): n is a, c, g, or t
  modified_base (368)..(369): a, c, t, g, unknown or other
  misc_feature (368)..(369): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (385)..(386): a, c, t, g, unknown or other
  misc_feature (385)..(386): n is a, c, g, or t
  modified_base (388)..(418): a, c, t, g, unknown or other
  misc_feature (388)..(418): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtggggggctactcctggcgttttgactactggggccaggganccctggtcacgtctcctcagcctcaccaagggcccatcggtcttcccctggcnccctgctccagagcacctctgggggctacagccggccctgggactgcctgggtcaacgggactacttccgatctacactactgagcgggtctggcaaggcgcatagngnngnctnngnangatcatgcnganncnnnnnnnnnnnnnnnnnnnnnnnnnnnnnnn

SEQ ID NO: 143692 - DNA, 357 bp, Homo sapiens
  misc_feature: GYAE6OF02GWPMO.37.17.B06.1.454.CMB.1.raw
  modified_base (324)..(324): a, c, t, g, unknown or other
  misc_feature (324)..(324): n is a, c, g, or t
  modified_base (353)..(357): a, c, t, g, unknown or other
  misc_feature (353)..(357): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccctggcgccctgcctccaggagcacctccgagagcacagcgccctgggctgcctggtcaaggctacttccatctacnctactgagcgggctggcaaggcgcatagnnnnn

SEQ ID NO: 143693 - DNA, 476 bp, Homo sapiens
  misc_feature: GYAE6OF02H3E50.37.17.B06.1.454.CMB.1.raw
  modified_base (291)..(291): a, c, t, g, unknown or other
  misc_feature (291)..(291): n is a, c, g, or t
  modified_base (431)..(431): a, c, t, g, unknown or other
  misc_feature (431)..(431): n is a, c, g, or t
  modified_base (433)..(476): a, c, t, g, unknown or other
  misc_feature (433)..(476): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtggggggctactccgtggcgttttgactacgtgggggccaggggacgcccgtggtccaccgtctcctcagcctccaccgaacgggccctagtccggttccttcccccgtgggcccgtccctggcctccgaggngcctaccctccgagacgccaacgacggccggccccgtaggggcctgaccccgtggtaacaacgggtacctaccttaccatcctaacaccgtactggacgggtaccgggtcgtaggacggaacggtccggaactaagtagnannnnnnnnnnnnnnnnnnnnnnnnnnnnnnnnnnnnnnnnnnnn

SEQ ID NO: 143694 - DNA, 384 bp, Homo sapiens
  misc_feature: GYAE6OF02F1ZUA.37.17.B06.1.454.CMB.1.raw
  modified_base (359)..(384): a, c, t, g, unknown or other
  misc_feature (359)..(384): n is a, c, g, or t
tcagtagtgtagatcacgaccggtgctcgatttagtcgatagtgaagggccggcttcaccatctccagagactattccaagagcactctgtatctggcaaatgaacagcctgagtgccgaggacacggccctatattattgtgcgaaatgtggggggagtggggggctactcctggcgttttgactactggggccaggggagccctggtcaccgtctcctcagcctccaccaagggcccatcggtcttccccctggcgccctgctccaggagcacctccgagagcacagcggccctgggctgcctggtcaaggctacgttccatctacactactgagtcgggctggcaaggcgcatagnnnnnnnnnnnnnnnnnnnnnnnnnn

SEQ ID NO: 143695 - DNA, 401 bp, Homo sapiens
  misc_feature: GYAE6OF02HTEG7.37.17.B06.1.454.CMB.1.raw
  modified_base (275)..(275): a, c, t, g, unknown or other
  misc_feature (275)..(275): n is a, c, g, or t
  modified_base (381)..(401): a, c, t, g, unknown or other
  misc_feature (381)..(401): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccgagggagccctggtcaccgtctcctcacgcctccaccaagggcccatcggtccttcccctggccgccctgctcgaggacnctaacctcgagagcacgagccggccctgggctcgccgtggtaccgaaggtactaccttccaactcctaacactacgtgacggcggcgtggacaaggcgacagtagnnnnnnnnnnnnnnnnnnnnn

SEQ ID NO: 143696 - DNA, 475 bp, Homo sapiens
  misc_feature: GYAE6OF02IHSS1.37.17.B06.1.454.CMB.1.raw
  modified_base (167)..(167): a, c, t, g, unknown or other
  misc_feature (167)..(167): n is a, c, g, or t
  modified_base (401)..(401): a, c, t, g, unknown or other
  misc_feature (401)..(401): n is a, c, g, or t
  modified_base (425)..(426): a, c, t, g, unknown or other
  misc_feature (425)..(426): n is a, c, g, or t
  modified_base (429)..(475): a, c, t, g, unknown or other
  misc_feature (429)..(475): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggaggtgggggntactcctggtcgttttgactacgtggggccagggagcccgtggtcaccggtcctcctcacgcctccaccgaacgggcccagtcggttccttccccccgtgggccgccctgcctcccgaggacgccacctccgagagccaacgcggccggcccgttggggcctcggcccgtggtaccgaaacggtaccttaaccgttccaacttctacccgtactctacgggacggcggggtcgnggtacgaacggtcacgtaagtagnntgnnnnnnnnnnnnnnnnnnnnnnnnnnnnnnnnnnnnnnnnnnnnnnn

SEQ ID NO: 143697 - DNA, 482 bp, Homo sapiens
  misc_feature: GYAE6OF02IF0W9.37.17.B06.1.454.CMB.1.raw
  modified_base (442)..(482): a, c, t, g, unknown or other
  misc_feature (442)..(482): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccaggggagccctggtcaccgttctccctcacgcctccaccgaacgggccccatccgggttccttccccccgtgggccgcccctgcctccgaggacgccaccctccggagacgccacgacggccggcccgtggggccctggcccgtcgggtaccgaaagggtcccttaaccttacccacttaccgtaacctaccttaacgtcggaacgggtccgggtcgtacgggaccaaagggccgactaagtacgcannnnnnnnnnnnnnnnnnnnnnnnnnnnnnnnnnnnnnnnn

SEQ ID NO: 143698 - DNA, 601 bp, Homo sapiens
  misc_feature: GYAE6OF02H8N3B.37.17.B06.1.454.CMB.1.raw
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (546)..(547): a, c, t, g, unknown or other
  misc_feature (546)..(547): n is a, c, g, or t
  modified_base (550)..(551): a, c, t, g, unknown or other
  misc_feature (550)..(551): n is a, c, g, or t
  modified_base (553)..(554): a, c, t, g, unknown or other
  misc_feature (553)..(554): n is a, c, g, or t
  modified_base (556)..(557): a, c, t, g, unknown or other
  misc_feature (556)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
  modified_base (572)..(573): a, c, t, g, unknown or other
  misc_feature (572)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (582)..(583): a, c, t, g, unknown or other
  misc_feature (582)..(583): n is a, c, g, or t
  modified_base (585)..(586): a, c, t, g, unknown or other
  misc_feature (585)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (595)..(596): a, c, t, g, unknown or other
  misc_feature (595)..(596): n is a, c, g, or t
  modified_base (599)..(601): a, c, t, g, unknown or other
  misc_feature (599)..(601): n is a, c, g, or t
tcagtagtgtagatcacgaccggtgctcgatttagtcgatagtgaagggccgcttcaccatctccagagactattccaagagcactctgtatctgcaaatgaacagcctgagtcgccgaggacacggccctatattattgtgcgaaatggtggggggaggtgggggctactccgtggtcgttttgactagtcggggccagggacgccctgggtaccaccgttcctccctcgacgccctccgaaccgaacgggcccacgtccggttccttccccccgtggcccgtcccgtgaccgtccgagggactaccgaccccgtcggacgaacggccaagtcggcccggtccccgtggggcccttcggtcccgttaacggtactaaccgggtaaaccttaacccttttcctaaaccgttccgtaaaaccctaaccgtaacgttaacggggacggtacccggggggcttacgggaaccggaccgggtaacccgcggttaaaaacaccggcgtagngcgngtcgcngancgcgcgngngngcngangngancnganngcnncnncnncngngngangacncnngngngtgcnncnngncngancnntcnnn

SEQ ID NO: 143699 - DNA, 452 bp, Homo sapiens
  misc_feature: GYAE6OF02F2CU5.37.17.B06.1.454.CMB.1.raw
  modified_base (223)..(223): a, c, t, g, unknown or other
  misc_feature (223)..(223): n is a, c, g, or t
  modified_base (279)..(279): a, c, t, g, unknown or other
  misc_feature (279)..(279): n is a, c, g, or t
  modified_base (403)..(452): a, c, t, g, unknown or other
  misc_feature (403)..(452): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactcctggtcgttttgactacgtggggccaggggagccctggtcaccgtctcctcngcctccaccaagggccccatccggtccttccccctggccgccctgcctccagggcnccacccgtccggagagccacgacggccggcccgtggggcctggcccgttggtccgaacggtaccttacttccatctaccactacgtgacggcggggtctgggaccgaacggcgacaatacgggnnnnnnnnnnnnnnnnnnnnnnnnnnnnnnnnnnnnnnnnnnnnnnnnnn

SEQ ID NO: 143700 - DNA, 502 bp, Homo sapiens
  misc_feature: GYAE6OF02FYZU4.37.17.B06.1.454.CMB.1.raw
  modified_base (198)..(198): a, c, t, g, unknown or other
  misc_feature (198)..(198): n is a, c, g, or t
  modified_base (451)..(502): a, c, t, g, unknown or other
  misc_feature (451)..(502): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctgtcgttttgactactggggccagggnccctggtcaccgtctcctcagccctccaccaagggcccatcggtccttcccccgtggccgcccctgcctccgaggacgccaacctccggaagaacgccaacgacggccgggcccctgggggcctcggaccccgttggggtaccaaaagggtacccttaaaccgtttacccaacttacccgttaaccaaccttaaccttgggaacgggccgggggtctaggggaccgaaaggggccacgtaacgtaggctcagnnnnnnnnnnnnnnnnnnnnnnnnnnnnnnnnnnnnnnnnnnnnnnnnnnnn

SEQ ID NO: 143701 - DNA, 371 bp, Homo sapiens
  misc_feature: GYAE6OF02GPK6W.37.17.B06.1.454.CMB.1.raw
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
  modified_base (360)..(371): a, c, t, g, unknown or other
  misc_feature (360)..(371): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaacgggccccatccggtccttccccctggccgccctgcctccaggagccacctccgagagcacagccggccctgggcngcctggtcaagctacttcatctacnctactgagcggctggacaaggcncgatagnnnnnnnnnnnn

SEQ ID NO: 143702 - DNA, 521 bp, Homo sapiens
  misc_feature: GYAE6OF02FHLUU.37.17.B06.1.454.CMB.1.raw
  modified_base (198)..(198): a, c, t, g, unknown or other
  misc_feature (198)..(198): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (366)..(366): a, c, t, g, unknown or other
  misc_feature (366)..(366): n is a, c, g, or t
  modified_base (369)..(372): a, c, t, g, unknown or other
  misc_feature (369)..(372): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatgtggggggatgggggctactcctggcgtttttgactactggggccaggganccctggtcaccgtctcctcagcctccaccaagggccccatccggtcttccccctggcaccccgtcctccaagacgcacctctgggggcacgagcggccctgggcctcggcctggtcaaggactacgttcatctacncgtactgancgggctggcaaggcgctatacgnacnnnncngatcatcgctgnactgcagttcancgttcancgncgnaacttcancaacncgacagacacacgagacacacgttcacgtcgacgactacgacgacgtacgtacgacgtactacgtacgtacgtacgtcgtacgtacgtactacgacg

SEQ ID NO: 143703 - DNA, 473 bp, Homo sapiens
  misc_feature: GYAE6OF02GGG02.37.17.B06.1.454.CMB.1.raw
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (436)..(436): a, c, t, g, unknown or other
  misc_feature (436)..(436): n is a, c, g, or t
  modified_base (438)..(473): a, c, t, g, unknown or other
  misc_feature (438)..(473): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccagggagccctggtcaccgtctcctcagcctccaccgaacgggccccatccggtccttcccccgtggccgccctgcctccgaggngccaccnccgagacgcacgacggccggcccgtggggcctcggtcccgttcggggtacgaaaacgggtaccttacccgtttacccaacttccttaaccaaccttacgtggaacgggccgggggtacctggggaccgaaaggggccgtacgaataacggncnnnnnnnnnnnnnnnnnnnnnnnnnnnnnnnnnnnn

SEQ ID NO: 143704 - DNA, 622 bp, Homo sapiens
  misc_feature: GYAE6OF02GR22H.37.17.B06.1.454.CMB.1.raw
  modified_base (398)..(398): a, c, t, g, unknown or other
  misc_feature (398)..(398): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
  modified_base (522)..(522): a, c, t, g, unknown or other
  misc_feature (522)..(522): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacgcctatattattgtgcgaaatggtgggggagtggggctacgtcctggtcgttttgactacgtgggccgagggacgtccctggtccgaccgtctcctcacgtcctccaaccgaacgggcccctagtccgggttcccttcccccgtggcccgtcccctgtcctccgaaggacgtccaaccctccggagacgcctaccgaggtcccggccctcgggccgttacgccgttggtaccgaacggtaccttaccttccaagttccctaaactacgttaacncgggaagccggggtactcggaccgtaaggaccgtacgaggtacgtctcgtagacncgtngtacagcngtnacgngtactcgtcgcgtctcngtacgtcncgngtgtgtcgtcgtacgtcgtcgngtacgcgacgtacgtcgtagtacgtacgtacgcgtcgtcgtacgtacgtcgtcgtacgtcgtcgtacgtcgtactacgtagtacgtcgtacgtacgtacg

SEQ ID NO: 143705 - DNA, 519 bp, Homo sapiens
  misc_feature: GYAE6OF02FMP3Z.37.17.B06.1.454.CMB.1.raw
  modified_base (144)..(144): a, c, t, g, unknown or other
  misc_feature (144)..(144): n is a, c, g, or t
  modified_base (325)..(325): a, c, t, g, unknown or other
  misc_feature (325)..(325): n is a, c, g, or t
  modified_base (408)..(408): a, c, t, g, unknown or other
  misc_feature (408)..(408): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (464)..(465): a, c, t, g, unknown or other
  misc_feature (464)..(465): n is a, c, g, or t
  modified_base (467)..(468): a, c, t, g, unknown or other
  misc_feature (467)..(468): n is a, c, g, or t
  modified_base (470)..(470): a, c, t, g, unknown or other
  misc_feature (470)..(470): n is a, c, g, or t
  modified_base (472)..(519): a, c, t, g, unknown or other
  misc_feature (472)..(519): n is a, c, g, or t
tcagtagtgtagatcacgaccggtgctcgatttagtcgatagtgaagggccgcttcaccatctccagagactattccaagagcactctgtatctgcaaatgaacagcctgagtcgccggaggacaccggccctatattacttgngacgtaaatgggtggggggagtgggggctactccgtggtcgtttttgaccttacgtcggggccaggggacgtcccgtggtccacccggttctccgtcgacgccccgtaccaccgaacggggccccctagtcccgtccttcccccagggcccgccccgtgccttacccggacggcgtacccnccgttccggagcgaccacgacggcccggtccccgtgggctcggtcccgtaggtacccaaaggccttaactccagtactaaccnctaaccgtgacgggtccggctacgggacaaccggcgtacctagtaacgnatncgtnntnncntnnnnnnnnnnnnnnnnnnnnnnnnnnnnnnnnnnnnnnnnnnnnnnnn

SEQ ID NO: 143706 - DNA, 531 bp, Homo sapiens
  misc_feature: GYAE6OF02IDUYC.37.17.B06.1.454.CMB.1.raw
  modified_base (268)..(268): a, c, t, g, unknown or other
  misc_feature (268)..(268): n is a, c, g, or t
  modified_base (471)..(471): a, c, t, g, unknown or other
  misc_feature (471)..(471): n is a, c, g, or t
  modified_base (475)..(531): a, c, t, g, unknown or other
  misc_feature (475)..(531): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatatttatgtgacgaaatggtggggggagtgggggctactcctggtcgttttgactacgtggggccaggggacgcccgtggtccaccgtcctcctcacgccctccaccgaacgggccccagtcggtcccttcccccgnggcccgcctgcctccgaggacgccaccctcgagacgccaacgacggcccggtccccgtggggccctcggtcccgttcgggtaccgaaaacggggtacccttaaacccgtttcccaattacccgtaaacctaaccgttaaccgttgggaacgggtcccgggggtccgtacggggaccggaaaacgggcccgtacgaaggtacgngtannnnnnnnnnnnnnnnnnnnnnnnnnnnnnnnnnnnnnnnnnnnnnnnnnnnnnnnn

SEQ ID NO: 143707 - DNA, 475 bp, Homo sapiens
  misc_feature: GYAE6OF02ILRI4.37.17.B06.1.454.CMB.1.raw
  modified_base (368)..(368): a, c, t, g, unknown or other
  misc_feature (368)..(368): n is a, c, g, or t
  modified_base (432)..(433): a, c, t, g, unknown or other
  misc_feature (432)..(433): n is a, c, g, or t
  modified_base (435)..(475): a, c, t, g, unknown or other
  misc_feature (435)..(475): n is a, c, g, or t
tcagtagtgtagatcacgaccggtgctcgatttagtcgatagtgaagggccgcttcaccatctccagagactattccaagagcactctgtatctgcaaatgaacagcctgagtgccgagacacggccctatattattgtgcgaaatggtggggggagtggggggctactcctggtcgttttgactacgtggggccagggacgccctggtcaccgtctcctcacgcctccaccgaacgggccccagttcgtcccttcccccgtggcccgtccctcgcctccgagggacgccaccccgtccggagacgccacacggcccggcccgtggggcctcgccgtcggtaccgaacggtaccttacctttacccgnttacctaaccgacttacgtaggacggtccgggacgtcgggaacgtacgggacctcgtaataggnngnnnnnnnnnnnnnnnnnnnnnnnnnnnnnnnnnnnnnnnnn

SEQ ID NO: 143708 - DNA, 473 bp, Homo sapiens
  misc_feature: GYAE6OF02FR5H0.37.17.B06.1.454.CMB.1.raw
  modified_base (279)..(279): a, c, t, g, unknown or other
  misc_feature (279)..(279): n is a, c, g, or t
  modified_base (326)..(326): a, c, t, g, unknown or other
  misc_feature (326)..(326): n is a, c, g, or t
  modified_base (431)..(473): a, c, t, g, unknown or other
  misc_feature (431)..(473): n is a, c, g, or t
tcagtagtgtagatcacgaccggtgctcgatttagtcgatagtgaagggccgctttcaccatctccagagactattccaagagcactctgtatctgcaaatgaacagcctgagtgccgaggacacggccctatattattgtgcgaaatggtggggggagtgggggctactctggcgtttgactacgtggggccagggacgcccgtggtcaccgttctcctcagcctccaccgaacgggcccagtcggtccttcccctggccgccctgcctccgaagggnccgtaccctccggaagagcaacgtacggccgggccccgtggggtccnggtaccctgggtaccaaaggtacctaccgtttacccatcccttaacaaccgttacgttcggaacggtcggggcctacggggtacaacgggccactaagaggcagnnnnnnnnnnnnnnnnnnnnnnnnnnnnnnnnnnnnnnnnnnn

SEQ ID NO: 143709 - DNA, 454 bp, Homo sapiens
  misc_feature: GYAE6OF02FT4M0.37.17.B06.1.454.CMB.1.raw
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (378)..(378): a, c, t, g, unknown or other
  misc_feature (378)..(378): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (402)..(403): a, c, t, g, unknown or other
  misc_feature (402)..(403): n is a, c, g, or t
  modified_base (405)..(409): a, c, t, g, unknown or other
  misc_feature (405)..(409): n is a, c, g, or t
  modified_base (411)..(454): a, c, t, g, unknown or other
  misc_feature (411)..(454): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtggggggctactcctggcgtttttgactacgtggggccagggganccctggtcaccgtctcctcngccctccaaccgaaggccccatccggttccttccccctgggtccgccccgtgcctaccngggacnccacctccgaagacgacacacggccggcccctggggcctcggcctggacgaagacttacctccactcactactactggacggcgggtcnggacgacgccgcgaactgncngcnncnnnnncnnnnnnnnnnnnnnnnnnnnnnnnnnnnnnnnnnnnnnnnnnnn

SEQ ID NO: 143710 - DNA, 600 bp, Homo sapiens
  misc_feature: GYAE6OF02F4WVU.37.17.B06.1.454.CMB.1.raw
  modified_base (290)..(290): a, c, t, g, unknown or other
  misc_feature (290)..(290): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtggggggagtgggggctactccgtggtcgttttgactacgtcggggccaggggacgccctggtccaccgttctcctcacgccctaccaccgaacgggcccagttccggttccttccccgtggccgccctgcctccgaggcnccaccgtacgagacgcacgagcccggtccgtgggctcgccgtggtacaacggtacctaccttccgattaccaccaccgttacgcggaacggccggggtacgtacgggacgaacgggtccactaagtacgngactgacncgtgacgtcagcctgngactacgcgtancgacacgtcagtcgtctgtacgtcncgtatacacgtcgtacgctcgtacgtcgtcgcgtcgtagacgtcgtacgtcgtacgtacgtacgtacgtacgtacgtcgtcgtcgtaccgtcgtacgtacgtaccgtcgacgtacgtcg

SEQ ID NO: 143711 - DNA, 474 bp, Homo sapiens
  misc_feature: GYAE6OF02HNFIB.37.17.B06.1.454.CMB.1.raw
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
  modified_base (443)..(474): a, c, t, g, unknown or other
  misc_feature (443)..(474): n is a, c, g, or t
tcagtagtgtagatcacgaccggtgctcgatttagtcgatagtgaagggccgcttcaccatctccagagactattccaagagcactctgtatctgcaaatgaacagcctgagtgccgaggacacggccctatattattgtgcgaaatggtgggggggagtgggggctactccgtggtcgtttttgactacgtgggggccaggggacgccccgtggtccacccgtctccctcacgcctacccaaccgaacgggccccagttccgggtcccttcccccgtgggccgccctgcctccgaggcnccacccgtaccgagacnccaacgcgcccggcccgttggggcctcgcccgtagggtaccaacgggtccttaaccgttccaacttccgtaacacgttacgtgggacggccggggtccgtgggacgtaaggccgactaaagtggcnnnnnnnnnnnnnnnnnnnnnnnnnnnnnnnn

SEQ ID NO: 143712 - DNA, 314 bp, Homo sapiens
  misc_feature: GYAE6OF01D3EFG.44.42.D09.1.454.CMB.1.raw
  modified_base (294)..(294): a, c, t, g, unknown or other
  misc_feature (294)..(294): n is a, c, g, or t
  modified_base (310)..(314): a, c, t, g, unknown or other
  misc_feature (310)..(314): n is a, c, g, or t
tcagacagtatatacacgaccggtgctcgatttagacacatacgcagggaaagggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaacccactgtcactctgttcccaccctcctctatatactgtctgagcgggntggcaaggcgcatagnnnnn

SEQ ID NO: 143713 - DNA, 445 bp, Homo sapiens
  misc_feature: GYAE6OF01BMKNR.44.42.D09.1.454.CMB.1.raw
  modified_base (441)..(445): a, c, t, g, unknown or other
  misc_feature (441)..(445): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgaccccgtggggccagggaaccctggtcaccgtctcctcacgcctccaccaagggcccatcggtccttccccctggccaccctcctccaaagacgcacctcgtggggcacacgcggccctgggctgcccgtggtcaaggctacgttcctatctactgtctgagtcgggctggcaaggcgcatagnnnnn

SEQ ID NO: 143714 - DNA, 433 bp, Homo sapiens
  misc_feature: GYAE6OF01D3MKW.44.42.D09.1.454.CMB.1.raw
  modified_base (429)..(433): a, c, t, g, unknown or other
  misc_feature (429)..(433): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcaactggctcgacccctggggccagggaaccctggtcaccgtctcctcagcctccaccaagggcccatcggtcttccccctggccaccctcctccaagagcacctctgggggcacagcggccctgggctgcctggtcaaggctactccacgtctactgctgagcgggctggcaaggcgcatagnnnnn

SEQ ID NO: 143715 - DNA, 640 bp, Homo sapiens
  misc_feature: GYAE6OF01C6CNF.44.42.D09.1.454.CMB.1.raw
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (583)..(586): a, c, t, g, unknown or other
  misc_feature (583)..(586): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (602)..(602): a, c, t, g, unknown or other
  misc_feature (602)..(602): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (616)..(616): a, c, t, g, unknown or other
  misc_feature (616)..(616): n is a, c, g, or t
  modified_base (620)..(620): a, c, t, g, unknown or other
  misc_feature (620)..(620): n is a, c, g, or t
  modified_base (627)..(628): a, c, t, g, unknown or other
  misc_feature (627)..(628): n is a, c, g, or t
  modified_base (630)..(630): a, c, t, g, unknown or other
  misc_feature (630)..(630): n is a, c, g, or t
  modified_base (632)..(633): a, c, t, g, unknown or other
  misc_feature (632)..(633): n is a, c, g, or t
  modified_base (636)..(640): a, c, t, g, unknown or other
  misc_feature (636)..(640): n is a, c, g, or t
tcagacagtatatacacgaccggtgctcgatttagacacatacgcaagggaaagggactggggagtggattcggtacgcatctataacagtggcagcaccgaacctacaaccccgccctcaacgacgtcggagtccaccatgtcactagacaggtccaagaaccagttctccctgaaattgacttctgtgaccgccgcggaccaccggccgtactacttattgtgcgagtagattcctatcgaatacagtaagaggacggggggcaacgtggctccgacccgtggggaccaacgggaaccctggtacctaaccggttactccgtacacgccctaccaaccgaacgggccccgaacttacccgggttaccccttaccccccgtcggaccctacccccttcctacccgaaacgacgacctaacccgtccggtacgggggaccaaccggacggcccggcccgtagggccttcggcccgttaggtaccgaacggtaccttaccgttacctaatttaacttaaccgttcgtacgttaggacggtccgggcgttacgggaccgtaacgggcgacgtaagtacgncanannnnagnananananacacncacncncncgacgngagngagagannananngcnnnnn

SEQ ID NO: 143716 - DNA, 436 bp, Homo sapiens
  misc_feature: GYAE6OF01DIJ6V.44.42.D09.1.454.CMB.1.raw
  modified_base (430)..(436): a, c, t, g, unknown or other
  misc_feature (430)..(436): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgaccctggggccagggaccctggtcaccgtctcctcagcctccaccaagggcccatcggtcttccccctggcaccctcctccaagacgcacctctgggggcacacgcggccctgggctgcctggtcaaggctacttccacgtctactgctgagcgggctggcaaggcgcatagnnnnnnn

SEQ ID NO: 143717 - DNA, 456 bp, Homo sapiens
  misc_feature: GYAE6OF01BE32J.44.42.D09.1.454.CMB.1.raw
  modified_base (246)..(246): a, c, t, g, unknown or other
  misc_feature (246)..(246): n is a, c, g, or t
  modified_base (440)..(456): a, c, t, g, unknown or other
  misc_feature (440)..(456): n is a, c, g, or t
tcagacagtatatacacgaccggtgctcgatttagacacatacgcagggaaagggactggagtggattgggcgcatctataacagtggcagcaccaactacaaccccgcctcaagagtcgagtcaccatgtcactagacaggtccaagaaccagttctccctgaaattgacttctgtgaccgccgcggacacggccgtatattattgtgcgagagattcctatcgatacagtagagacgggggggnaactggctcgacccctggggccagggaaccctggtcaccgtctcctcacgcctccaccaagggccccatccggtcttcccccctggccaccctcctccaagacgccacctctggggcacgagcggccctggggctgcctggtcaagggctacgttcctatactactgtctgagcgggctggcaaggcgcatagnnnnnnnnnnnnnnnnn

SEQ ID NO: 143718 - DNA, 566 bp, Homo sapiens
  misc_feature: GYAE6OF01CFU7L.44.42.D09.1.454.CMB.1.raw
  modified_base (236)..(236): a, c, t, g, unknown or other
  misc_feature (236)..(236): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacnttgggagatataaccttgtctcctggtatcaataacatccaggcaaacgccccaaactcattacttttgagtccagtgacgcggccgtcgaggttgtttactaatcgtcttctcgtggctccaagtcgtcggaccacgaccggcctcccgtgtccgtatcctcgtgggcctcccggctggacggacgacgtctagtactatccgtgcgtctacgtactttacacttcgttagacgtacgttgggtcgttcgggcgggtacggtacctcgaccgtcggtacccgttccgtaggtccagaccacgaacggcctccggcccccgttggtaccc

SEQ ID NO: 143719 - DNA, 460 bp, Homo sapiens
  misc_feature: GYAE6OF01AFIRL.44.42.D09.1.454.CMB.1.raw
  modified_base (454)..(460): a, c, t, g, unknown or other
  misc_feature (454)..(460): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacggggggcaacgtggctcgaccccgtggggccagggaaccctggtcaccgtctcctcagcctccaccaacgggccccatccggtccttccccctggccacccctccctccaacgacgccaccctcgtcgggggcacgacgccggccctggggctcggcctggtcaaggactacttcctatatactgtctgagcgggctgggcaaggcgcagtagnnnnnnn

SEQ ID NO: 143720 - DNA, 538 bp, Homo sapiens
  misc_feature: GYAE6OF01CZBPY.44.42.D09.1.454.CMB.1.raw
  modified_base (505)..(505): a, c, t, g, unknown or other
  misc_feature (505)..(505): n is a, c, g, or t
  modified_base (508)..(510): a, c, t, g, unknown or other
  misc_feature (508)..(510): n is a, c, g, or t
  modified_base (512)..(538): a, c, t, g, unknown or other
  misc_feature (512)..(538): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaaagaaccagttctccctgaaattgacttctgtgaccgccgcggacacggccgtatattattgtgcgagagattcctatcgatacagtagaggacgggggggcaacgtggctcggaccccgtggggccagggaaccctggtcaccgtctcctcagcctccaccgaagggccccagttccggtccttccccgtcggccgcccgttcgcctccgaggacgccaccgtcggtgggggcctacgacggccggcccgtgggctcgcccgtggtacgaacgggtacttacccttcgtaccgatccggacgttcgtacggacggtccggggtccgtgggaccgtaacgggccgtacgaacgttggngcnnngnnnnnnnnnnnnnnnnnnnnnnnnnnn

SEQ ID NO: 143721 - DNA, 432 bp, Homo sapiens
  misc_feature: GYAE6OF01DCMO9.44.42.D09.1.454.CMB.1.raw
  modified_base (429)..(432): a, c, t, g, unknown or other
  misc_feature (429)..(432): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctcccttaaattgacttctgtgaccgccgcggacacggccgtatattattgtgcgagagattcctatcgatacagtagagacggggggcgaactggctcgacccctggggccagggaaccctggtcaccgtctcctcagcctccaccaaggcccatcggtcttccccctggcaccctcctccaagagcacctctgggggcacagcggccctgggctgcctggtcaaggctacttcctatatactgtctgagcgggctggcaaggcgcatagnnnn

SEQ ID NO: 143722 - DNA, 712 bp, Homo sapiens
  misc_feature: GYAE6OF01CCO9M.44.42.D09.1.454.CMB.1.raw
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
tcagacagtatatacacgaccggtgctcgatttagacacatacgcaggggaaaggggggggtcacaagaggcagcgctctcgggacgtctccaccatggcctgggctcgtgctgctcctcactctcctcactcgaggacacagggtcctggggcccaggtctgccctgactcagcctgcctcgtntctggttcncctggacagtcgatcacatctcctgccacgtgggtccagcaaagtgactagttgggatatactaaccttgtcctcgtgtactcaacacactccaggacaacgaccccaaatctaagtttacgttttagacgtccgtagtgacgtccgggtccgtcgtacggttctttacctaattccggtactttcgtcgtcggtctaccgtaacgttccgtacgggacccaccggtacccggtcccttacccgtacggttaccgacgttcccgttcgggtccgggtcccgtaccccggtccgttacggacgggtaccggtaccggtaccttacgtacctttacgttacgtcgtccgtctacgttaacgttacgtaccttcggttacggaacgttacggttcggggttaccgttaccggggcggtacgggttccctacgtcccgtacgggttaccccgttccggtacgggtacccaccgggacccggtaacggtccctaccccgggcccccgttaggtcccttacccg

SEQ ID NO: 143723 - DNA, 461 bp, Homo sapiens
  misc_feature: GYAE6OF01AJDJ5.44.42.D09.1.454.CMB.1.raw
  modified_base (454)..(461): a, c, t, g, unknown or other
  misc_feature (454)..(461): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaacgtggctcgacccctggggccagggaaccctggtcaccgtctcctcagcctccaccaacgggccccatccggtcctttcccccctggccaccccgtccctcccaagacgccaccctcgtgggggccacgacgccggccctggggctgccctggtcaaggacctacttccacgtctactgctgagcgggctggcaaggcgcatagnnnnnnnn

SEQ ID NO: 143724 - DNA, 460 bp, Homo sapiens
  misc_feature: GYAE6OF01C32NW.44.42.D09.1.454.CMB.1.raw
  modified_base (443)..(460): a, c, t, g, unknown or other
  misc_feature (443)..(460): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgactttctgtgaccgccgcggacacggccgtatattattgtgcgagagattcctatcgatacagtagaggacgggggggcaactggctccgacccgtggggccagggaaccctggtcaccgtctcctcagcctcaccaaggccatcggtctcccctggccaccctcctccaagacgcaccctctcgggggctaacagccggcccgtgggcctgcctggtcaagggcttacgtccagtctacgtgctgacgcgggctggacaggcgcaacgtagnnnnnnnnnnnnnnnnnn

SEQ ID NO: 143725 - DNA, 518 bp, Homo sapiens
  misc_feature: GYAE6OF01AEHAZ.44.42.D09.1.454.CMB.1.raw
  modified_base (505)..(518): a, c, t, g, unknown or other
  misc_feature (505)..(518): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcgaacgtggctcgaccccgtggggcccagggaaccctggtcaccgtctcctcacgcctccaccaacgggcccagtccggtccttccccctggccacccctcctccaacgacgccaccctcgtcgggggcaccgacggccggcccgtggggcctcggcccgtgggtaccgaaacgggtaccttacctttacccttattaactaccgttgttccgtggacggccggggtcgtcgggacgtaaacgggcgaccgagtacgnnnnnnnnnnnnnn

SEQ ID NO: 143726 - DNA, 699 bp, Homo sapiens
  misc_feature: GYAE6OF01EG6E7.44.42.D09.1.454.CMB.1.raw
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcactcaggacacagggtcctgggcccagtctgccctgactcagcctgcctcgtgtctggttctccgtggacagtcgatcaccatcctcctgcncgtgggaccagctaatcgacagttggganatactaaccgttgtctcctagtatacaacacatacagacaaacgccccaaactctattacttttgactccagtgagcgtccgtcgtaggttcgttactatccgtcttctcgtcgcctacagtctcggcccacgaccggtcccttaccgtcgttcgtacttccgtcgtcgggtcctcccggtcgtacgggacggaccggtacgggtccgttacgtacgtttagttaccggtcggtaccggtcctttacgttaaccgtttaaccgttaaaccttcgtttacggtaacgtttcgggtttacgggggtccggtttacggggccgggttacgggtacccttcccggtaaccgttaccggttaccccgggttaccggttaacgggtacccgaaccgggtaccccggtaacgggtcccgttaccccgggttccccccttcggggtaccctaccccggg

SEQ ID NO: 143727 - DNA, 558 bp, Homo sapiens
  misc_feature: GYAE6OF01APXO2.44.42.D09.1.454.CMB.1.raw
  modified_base (528)..(529): a, c, t, g, unknown or other
  misc_feature (528)..(529): n is a, c, g, or t
  modified_base (531)..(558): a, c, t, g, unknown or other
  misc_feature (531)..(558): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcaacgtgggcctcggaccccgtggggacccagggaaccctggtccaccggtctcctcacgccctaccaccgaacggggccccacgttccggtcccttccccccgtgggccctaccccgtccctacccgaagcgccacccgtcggtcgggggccaccgacggccgggtcccgtcggggcctcggcccgtagggtaccgaacgggtaacccttacgtttaccctaagttacgtaccttcgtcgttggacgggtcgggcgtcggacgaacgggcactagtacgnncnnnnnnnnnnnnnnnnnnnnnnnnnnnn

SEQ ID NO: 143728 - DNA, 500 bp, Homo sapiens
  misc_feature: GYAE6OF01CH2C2.44.42.D09.1.454.CMB.1.raw
  modified_base (473)..(476): a, c, t, g, unknown or other
  misc_feature (473)..(476): n is a, c, g, or t
  modified_base (478)..(500): a, c, t, g, unknown or other
  misc_feature (478)..(500): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgactttctgtgaccgccgcggacacggccgtatattattgtgcgagagattcctatcgatacagtagaggacggggggcaactggctcgaccctggggccagggaaccctggtcaccgtctcctcagccctccaccaagggccccagtccggtccttcccccctcggccacccctcctacccaagacgccaccctcgtcgggggcaccgacgccggcccgtggggcctcgcccgtgggttaccaagggacctaccttccacgttctactgctggacgcgggcgtcggctaagggcgacagtagnnnngnnnnnnnnnnnnnnnnnnnnnnn

SEQ ID NO: 143729 - DNA, 540 bp, Homo sapiens
  misc_feature: GYAE6OF01DW3LY.44.42.D09.1.454.CMB.1.raw
  modified_base (353)..(353): a, c, t, g, unknown or other
  misc_feature (353)..(353): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (508)..(525): a, c, t, g, unknown or other
  misc_feature (508)..(525): n is a, c, g, or t
  modified_base (527)..(540): a, c, t, g, unknown or other
  misc_feature (527)..(540): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttcctccctagaaattgactttctgtgaccgccgcggacacggccgtatattattgtgcgagagattcctatcgatacagtagaggacggggggcaacgtggctccggaccccgtggggacccagggaacccgtggacctaccggtcctccgtcacgccctaccgaaccgaacgggcccacgttccgtcccttccccnggcccaccctccaccagcgccaccgtcgcgggcacgacggccggcccgtggctcgccgttggacaacggtacctacgtttccgacgtatccggcttacgtggacgggccgggtacgtcgggacgtaaacgggccgtacgtaagagcngcgtngcnnnnnnnnnnnnnnnnnngnnnnnnnnnnnnnn

SEQ ID NO: 143730 - DNA, 645 bp, Homo sapiens
  misc_feature: GYAE6OF01E1T4W.44.42.D09.1.454.CMB.1.raw
  modified_base (264)..(264): a, c, t, g, unknown or other
  misc_feature (264)..(264): n is a, c, g, or t
  modified_base (571)..(571): a, c, t, g, unknown or other
  misc_feature (571)..(571): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (621)..(621): a, c, t, g, unknown or other
  misc_feature (621)..(621): n is a, c, g, or t
  modified_base (627)..(627): a, c, t, g, unknown or other
  misc_feature (627)..(627): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
tcagacagtatatacacgaccggtgctcgatttagacacatacgcagggaaagggactggagtggattgggcgcatctataacagtggcagcaccaactaccaaccccgccctcaagagtcgagtcaccatgtcactagacaggtccaagaaccagttctccctagaaattgacttctgtcgaccgccgcggtacacggccgtatattattggtgcgagagtattacctatcgtatacagtaggagggacggggggactaacgnggacctcgaaccgagtacggggaccgaacgggtaaccctggtaccgacccgtccgtacctcgacgtccctaccaccgaacggaccacgttccgtcccgttccccgtcgaccgtaccctcctaccgaacgtacgcctaccgttcggacggggaccacggacggccggtcccgtggtaccgtcggccgtacggtacgtaaagggttaccccttaacggttaccttaacgttaacgttacgttcggtacgtttacggacggtcgggtacgtaggtaaccgaacgggtcgaaccgtagttaacggctgtcncgacttgngcgtnacgnagtgactcgngncgtgcgtctgtacncgngagngacgtnatacgtanancgtgtcgc

SEQ ID NO: 143731 - DNA, 558 bp, Homo sapiens
  misc_feature: GYAE6OF01BB9XL.44.42.D09.1.454.CMB.1.raw
  modified_base (340)..(340): a, c, t, g, unknown or other
  misc_feature (340)..(340): n is a, c, g, or t
  modified_base (520)..(520): a, c, t, g, unknown or other
  misc_feature (520)..(520): n is a, c, g, or t
  modified_base (523)..(524): a, c, t, g, unknown or other
  misc_feature (523)..(524): n is a, c, g, or t
  modified_base (526)..(558): a, c, t, g, unknown or other
  misc_feature (526)..(558): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcaacgtggctcgaccccgtgggccagggaccctggtccaccgtctcctcgacgccctccaccgaacgggcccacgtccggtcccttcccccgnggcccaccccgttcctaccgaagacgcctaaccgtcggtaggggacccacgggcccggtcccgtacggggccttcggccctgggtaccgtaaggtaccttaccttacccgttaatacgttaccgtcggtacgtacggacggcccgggtcgtacgggacaacggggtcacgtagtagacgngcnngnnnnnnnnnnnnnnnnnnnnnnnnnnnnnnnnn

SEQ ID NO: 143732 - DNA, 623 bp, Homo sapiens
  misc_feature: GYAE6OF01EQI0N.44.42.D09.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (310)..(310): a, c, t, g, unknown or other
  misc_feature (310)..(310): n is a, c, g, or t
  modified_base (580)..(580): a, c, t, g, unknown or other
  misc_feature (580)..(580): n is a, c, g, or t
  modified_base (583)..(583): a, c, t, g, unknown or other
  misc_feature (583)..(583): n is a, c, g, or t
  modified_base (586)..(588): a, c, t, g, unknown or other
  misc_feature (586)..(588): n is a, c, g, or t
  modified_base (590)..(592): a, c, t, g, unknown or other
  misc_feature (590)..(592): n is a, c, g, or t
  modified_base (595)..(596): a, c, t, g, unknown or other
  misc_feature (595)..(596): n is a, c, g, or t
  modified_base (598)..(605): a, c, t, g, unknown or other
  misc_feature (598)..(605): n is a, c, g, or t
  modified_base (607)..(613): a, c, t, g, unknown or other
  misc_feature (607)..(613): n is a, c, g, or t
  modified_base (615)..(623): a, c, t, g, unknown or other
  misc_feature (615)..(623): n is a, c, g, or t
tcagacagtatatacacgaccggtgctcgatttagacacatacgcaggggaaagggactggagtgggattggggcgcatctataacagtggcagcaccaactacaacccccgccctcaagagtcgagtcaccatgtcactagacaggtccaagaaccagttctccctgaaattgacttctgtcgaccgccgcggacncggccgtatattattgtgcgagagattcctatcgatacagtagaggacggggggcaacgnggctccgacccgtggggcctacggggaaccctgggtccaccggttcctcctcncgcccttccaccgaacgggcccacgtccggtcctttcccccctacggcccgaaccccttcctacctaacgacgtcctaacccgtcggtcggggggacctaccggacggcccgggccccgtcgggggtacctcgggtccgttcggggtaacgaacgggtaacctttaacgtttacccttaagttaacctttaccgtttacgttccgtcgggtaacgggtccggggccgttagggggacccaacggggaccggttcaaacgggacgaagtgngtnacnnngnnncgnngnnnnnnnngnnnnnnntnnnnnnnnn

SEQ ID NO: 143733 - DNA, 489 bp, Homo sapiens
  misc_feature: GYAE6OF01DV88Y.44.42.D09.1.454.CMB.1.raw
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (450)..(450): a, c, t, g, unknown or other
  misc_feature (450)..(450): n is a, c, g, or t
  modified_base (469)..(489): a, c, t, g, unknown or other
  misc_feature (469)..(489): n is a, c, g, or t
tcagacagtatatacacgaccggtgctcgatttagacacatacgcaagggaaagggactggagtggattgggcgcatctataacagtggcagcaccaactaccaacccccgccctcaagagtcgagtcaccatgtcactagacaggtccaaagaaccagttcctccctagaaattgtactttctgtcgacccgccgcggacaccggccgtattattattgtgcgagagtattcctatcgatacgagtaggagggaccggggggcaacgtcggcctccggaccccgtgggacccgacgggaccctggtaccaccgtcctcctcacgccnccacgacggccncgtccgtcctccccgngcccacctccncaancncaccgcgcgggcacgcgccgccgtggctcgcgtcggtacacgtcctacgtccgtactctactcgcgtgacggccggngtcggcgaggcacgagtgnnnnnnnnnnnnnnnnnnnnn

SEQ ID NO: 143734 - DNA, 820 bp, Homo sapiens
  misc_feature: GYAE6OF01ERH8P.44.42.D09.1.454.CMB.1.raw
tcagacagtatatacacgaccggtgctcgatttagacacatacgcagggaaagggactggagtggattgggcgcatctataacagtggcagcaaccaactacaaccccgcctcaagacgtcgagtcaccatgtcactagacaggtccaagaccagttctccctagaaacttgacttcgtgtcgaccgccgcggacacggtccgtatattattcgtgacgagtacgtacttcctagtacgtatacgagtacggacgggacgggggacaacgtggacctaccggacccgtgggaccgtaacgggtaacccttcggtacctaccgtcctaccgtacgacgtccctaccgaaccggtaaccgggccccgtaacgttcccgggttccccgttacccccgtacgggtacccctacccccgttacccgtaccgaaacggtacccgtacccgtaccccgttgggtacccggggaccaaccgggtaccggaccccggtacccgtcggggtacccgttcggtacccgttacggggtaacccgaacgggttacccgttaacccgttttaccccggaacggtttacccttaacccgggttcggtaaccggtaaccgggtccgggtaccgggggttaccgtaccgggggtaaaccccggtaacgggtacccggtaacggttaaccgtaacggggtctaccggtgacgtaacgtagttcccgaagccgaatacggtactcgtaactgaaccgtcgaccggttgtacgtaccgtacgacgacgtacgtacggtacgtcgtaccgtacgtacgtacgtacgtacgcgtacgagtcg

SEQ ID NO: 143735 - DNA, 672 bp, Homo sapiens
  misc_feature: GYAE6OF01A8R2P.44.42.D09.1.454.CMB.1.raw
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (622)..(623): a, c, t, g, unknown or other
  misc_feature (622)..(623): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (640)..(641): a, c, t, g, unknown or other
  misc_feature (640)..(641): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (660)..(660): a, c, t, g, unknown or other
  misc_feature (660)..(660): n is a, c, g, or t
  modified_base (663)..(664): a, c, t, g, unknown or other
  misc_feature (663)..(664): n is a, c, g, or t
  modified_base (670)..(670): a, c, t, g, unknown or other
  misc_feature (670)..(670): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaacccagttctccctgaaattgacttctgtgaccgccgcggacacggccgtatattattgtgcgagagattcctatcgatacagtagacggacgggggggcgaacgtggcctccggacccccgtgggggcccgaacgggggaaaccccttcggggtaccacccggttccttccctccgacggcccctaccccgaacccgaaacggggccccctaagttcccgggttcccctttcccccccggtcgggccctaaccccccgttcccttaccccgaaaaggcccgaccctaaccccgttccgggttcggggggaccaccgacggccccggccccggttcggggcctcggccggtcgggtaccgaaacgggtaccttaaccgtttccctaattaacgtaccgttcggtccttagggacggtccggggtcgtacgggacggaaacgggcgactagtacgtgctgctcgcgngngngnntncgcgngcncncnctnngntagtcncncgtcagacnacnngtctcnga

SEQ ID NO: 143736 - DNA, 438 bp, Homo sapiens
  misc_feature: GYAE6OF02JELC6.44.42.D09.1.454.CMB.1.raw
  modified_base (429)..(438): a, c, t, g, unknown or other
  misc_feature (429)..(438): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctccaccaagggcccatcggtcttccccctggcaccctcctccaagagcacctctggggcacagcggccctgggctgcctggtcaaggctacttccacgtctactgctgagcgggctggcaaggcgcatagnnnnnnnnnn

SEQ ID NO: 143737 - DNA, 451 bp, Homo sapiens
  misc_feature: GYAE6OF02HIXNW.44.42.D09.1.454.CMB.1.raw
  modified_base (444)..(451): a, c, t, g, unknown or other
  misc_feature (444)..(451): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctccacccaagggccccatccggtcttcccccctggccaccccgtcctccaagacgcacctcgtgggggccacgacgcggcccgtgggctgcctggtcaaggactacttcctcgatcgcgtctgagcgggctggcaaggcgcatagnnnnnnnn

SEQ ID NO: 143738 - DNA, 164 bp, Homo sapiens
  misc_feature: GYAE6OF02FUVOT.44.42.D09.1.454.CMB.1.raw
  modified_base (155)..(164): a, c, t, g, unknown or other
  misc_feature (155)..(164): n is a, c, g, or t
tcagacagtatatacacgaccggtgctcgatttagacacatacgcgagggaaagggacacgacttgagattaagcgaactgtggctgcaccatcctgtcttcatcttcccgccatctgatatatactgtctgagcgggctggcaaggcgcatagnnnnnnnnnn

SEQ ID NO: 143739 - DNA, 444 bp, Homo sapiens
  misc_feature: GYAE6OF02HZOQ8.44.42.D09.1.454.CMB.1.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (367)..(367): a, c, t, g, unknown or other
  misc_feature (367)..(367): n is a, c, g, or t
  modified_base (428)..(444): a, c, t, g, unknown or other
  misc_feature (428)..(444): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggnaactggctcgaccctggggccngggaaccctggtcaccgctcctcagcctccaccagggcccatcggtctcccctggcacctcctccaagagcacctctggggcacagcggccctgggcngcctggtcaaggctacgttcctatactactgtactgagcgggctggcaaaggcgcaatagnnnnnnnnnnnnnnnnn

SEQ ID NO: 143740 - DNA, 472 bp, Homo sapiens
  misc_feature: GYAE6OF02I5H6B.44.42.D09.1.454.CMB.1.raw
  modified_base (357)..(357): a, c, t, g, unknown or other
  misc_feature (357)..(357): n is a, c, g, or t
  modified_base (439)..(439): a, c, t, g, unknown or other
  misc_feature (439)..(439): n is a, c, g, or t
  modified_base (441)..(472): a, c, t, g, unknown or other
  misc_feature (441)..(472): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctcaccaaggcccatcggtctccccctggccaccgtcctcaagacgcaccctctggggcncagcggccctgggcctgcctggtcaacggactactcctatatactgtctcgagcgggctggcgtaacggcgacgactaggcngnnnnnnnnnnnnnnnnnnnnnnnnnnnnnnnn

SEQ ID NO: 143741 - DNA, 625 bp, Homo sapiens
  misc_feature: GYAE6OF02JG9Z9.44.42.D09.1.454.CMB.1.raw
  modified_base (365)..(365): a, c, t, g, unknown or other
  misc_feature (365)..(365): n is a, c, g, or t
  modified_base (579)..(579): a, c, t, g, unknown or other
  misc_feature (579)..(579): n is a, c, g, or t
  modified_base (588)..(588): a, c, t, g, unknown or other
  misc_feature (588)..(588): n is a, c, g, or t
  modified_base (595)..(595): a, c, t, g, unknown or other
  misc_feature (595)..(595): n is a, c, g, or t
  modified_base (600)..(600): a, c, t, g, unknown or other
  misc_feature (600)..(600): n is a, c, g, or t
  modified_base (603)..(604): a, c, t, g, unknown or other
  misc_feature (603)..(604): n is a, c, g, or t
  modified_base (607)..(607): a, c, t, g, unknown or other
  misc_feature (607)..(607): n is a, c, g, or t
  modified_base (609)..(625): a, c, t, g, unknown or other
  misc_feature (609)..(625): n is a, c, g, or t
tcagacagtatatacacgaccggtgctcgatttagacacatacgcaggaaagggactggagtggattgggcgcatctataacagtggcagcaccaactacaaccccgccctcaagagtcgagtcaccatgtcactagaccaggtccaagaaccagttctccctagaaactttgactttctgtacgaccgccgcggacctacgggcccgtatacttattgtgcgagagattcctaatcgatacagtagagacggggggcaacgtggactcggaccctggggccagggaaccccgtggtccgaccgtcgtcctcgagccctccacccgaacgggccccacgtaccggtccttccccccgtggtcccnccccgtcccttccgaacgacgcccaaccgtccgttacgggggctacccgaggccggacccctggggcctaccggcccttcggggttacccaacggggtaccctttaccgttacccgtaacgtttaccgttacccgttggttaccgttcgacgggttcccgggccttacggggccttaaaccggggcgtaccgaacgtacggcttcgacgacgtncgatcggtnccttagncagcncgnncgncnnnnnnnnnnnnnnnnn

SEQ ID NO: 143742 - DNA, 447 bp, Homo sapiens
  misc_feature: GYAE6OF02HFZU8.44.42.D09.1.454.CMB.1.raw
  modified_base (438)..(447): a, c, t, g, unknown or other
  misc_feature (438)..(447): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctccaccaagggccccatcggtccttccccctggccacccctcctccaagacgcacctcgtgggggcacgagcggccctgggctgcctggtcaaggaacttccgtcgatcgcgtctgacgcgggctggcgaggcgcatagnnnnnnnnnn

SEQ ID NO: 143743 - DNA, 624 bp, Homo sapiens
  misc_feature: GYAE6OF02IZK0D.44.42.D09.1.454.CMB.1.raw
  modified_base (369)..(369): a, c, t, g, unknown or other
  misc_feature (369)..(369): n is a, c, g, or t
  modified_base (491)..(491): a, c, t, g, unknown or other
  misc_feature (491)..(491): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcacccaggacacagggtcctgggcccagtctgccctgactcagcctgcctcgtgtctgggtcgcctggacagtcgtcaccatctctgcactggacgccaggacggtaatactttcttagtctttaacttttcgttctcctggttatacaacatcactccaaggtaaaccgaccccaaactcatcatctatcggagcctaagtacgacgcccctacgtagggtttctaagtcgtacttcactcnccctacgacgtccggacaaccgaccgtcctccctagacactctcgtcggtcctcgagcgtaggacggacgaggtctagtatttattagttgttgtacgtctagtagttcgttcgtcgtactnttacgttacttagttcgttacggttacgggaacgttacgggacccgtaagggtcccctaaccgggttaccttagggtaccaccggtacccgaaaccggaccctaaccccgtcgttacgttaccctacctcccg

SEQ ID NO: 143744 - DNA, 155 bp, Homo sapiens
  misc_feature: GYAE6OF02GISEM.44.42.D09.1.454.CMB.1.raw
  modified_base (153)..(155): a, c, t, g, unknown or other
  misc_feature (153)..(155): n is a, c, g, or t
tcagacagtatatacacgaccggtgctcgatttagacacatacgcagggaaagggacacgacttgagattaagcgaactgtggctgcaccatctgtcttcatcttcccgccatctgatatatactgtctgagcgggctggcaaggcgcatagnnn

SEQ ID NO: 143745 - DNA, 693 bp, Homo sapiens
  misc_feature: GYAE6OF02HK830.44.42.D09.1.454.CMB.1.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcacgtgggtccagcaatgacnttggganatatacttgtctcctgtatacaacaacatccaggaccaaacgcccccaaactcattacttttgacgtccagtcgagcggccgtacgtaggttcgtttactaatccgtctttctcgtcggtcctaccgtaagttccgtcggtacccaaccggtacccggtcccctttccccgttagtaccgtactttcccgtaccgttcgggaacccgttcccgggtaccttagggaaccgggtaccggtacggtaccgttaggtaactttttaagtttagttcggtttgtccttacgaacggttagttcggtttccgttaccgacttattaccgtacttttaacgtcgttacgtttacgggaacggttcgggaacccgtaacggtccgtaacccggttaccggtaaggtaccccaacggtaccccgaaaccggtacccctaacccccgtagttacccgg

SEQ ID NO: 143746 - DNA, 431 bp, Homo sapiens
  misc_feature: GYAE6OF02HA8XJ.44.42.D09.1.454.CMB.1.raw
  modified_base (390)..(390): a, c, t, g, unknown or other
  misc_feature (390)..(390): n is a, c, g, or t
  modified_base (392)..(431): a, c, t, g, unknown or other
  misc_feature (392)..(431): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcggtcacctatcctcctgccactggacgccgaggccggtacacgaccccgaaacggaccccaaaccccattcggtaccaaccttcgttccggttccccccgcccttccctacttacttaacttaacctcgttccgttaggacggtccggggtccgtacggaccggaacgggaccggtccgaattaaggcngnnnnnnnnnnnnnnnnnnnnnnnnnnnnnnnnnnnnnnnn

SEQ ID NO: 143747 - DNA, 528 bp, Homo sapiens
  misc_feature: GYAE6OF02GL1GA.44.42.D09.1.454.CMB.1.raw
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (498)..(501): a, c, t, g, unknown or other
  misc_feature (498)..(501): n is a, c, g, or t
  modified_base (503)..(528): a, c, t, g, unknown or other
  misc_feature (503)..(528): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaccctggtcaccgtctcctcagcctccaccgaacggcccacgtccggtccttccccccgtggcctacccctcctccaacgacgccacctcgtcggggcacgagccggcccgtgggcctcgcccgtggtaccaagggtacctaccgttcccgacggttcctaccgtgaccttggacggtccgggcttcgggacgtaacgggcgacgtaagtgctangnacgtngcnnnncnnnnnnnnnnnnnnnnnnnnnnnnnn

SEQ ID NO: 143748 - DNA, 600 bp, Homo sapiens
  misc_feature: GYAE6OF02IQQPM.44.42.D09.1.454.CMB.1.raw
  modified_base (288)..(288): a, c, t, g, unknown or other
  misc_feature (288)..(288): n is a, c, g, or t
  modified_base (346)..(346): a, c, t, g, unknown or other
  misc_feature (346)..(346): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (457)..(458): a, c, t, g, unknown or other
  misc_feature (457)..(458): n is a, c, g, or t
  modified_base (464)..(464): a, c, t, g, unknown or other
  misc_feature (464)..(464): n is a, c, g, or t
  modified_base (594)..(594): a, c, t, g, unknown or other
  misc_feature (594)..(594): n is a, c, g, or t
tcagacagtatatacacgaccggtgctcgatttagacacatacgcaggggaaagggggggtcacaagaggcagcgctctcgggacgtctccaccatggcctgggctctgctgctcctcactctcctcactcaggacacgagggtcctgggcccagtctcgccctgacctcgagccgtgcccgttccgtgtaccgtggggtccgcccgttggactacggtccggtccaccattcctcctacgcacgtggacgcccgaggccggtcagaccccgtaagccccaaccccgnttcggtacctacgttccgtcggttccccccaccgtccttacctaacgtactaccgttntaccggttaggacggtcggtacgttagggccaaacggggtccactaacgtacgcgacgcagtcnctacgcngtcagtntcngtcgcagtcgactgctgtcgagcgtagacnnctacgngctctacgacgacgtactacgtacgctcgtactctacgtacgagtacgactcgtagtacgtgagtacgtagtctcgacgtcgacgtacgtacgtaccgtaccgacgacgacgtacgtacgtcgtacgacncgtacg

SEQ ID NO: 143749 - DNA, 476 bp, Homo sapiens
  misc_feature: GYAE6OF02FJ3EG.44.42.D09.1.454.CMB.1.raw
  modified_base (445)..(445): a, c, t, g, unknown or other
  misc_feature (445)..(445): n is a, c, g, or t
  modified_base (453)..(454): a, c, t, g, unknown or other
  misc_feature (453)..(454): n is a, c, g, or t
  modified_base (456)..(458): a, c, t, g, unknown or other
  misc_feature (456)..(458): n is a, c, g, or t
  modified_base (460)..(476): a, c, t, g, unknown or other
  misc_feature (460)..(476): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagtctccctgaaattgacttctgtgacccgccgcggacacggccgtatattattgtgcgagagattcctatcgatacagtagagacgggggggcaactggctcgacccctggggccagggaacctggtcaccgtctcctcagcctccaccaacggggccccatccggtccttcccccctggtccacccctcctccaagacgccacctccgtgggggcctacgagccggccctggggctggcctcggtcaagggacctacttcctatatactgtctgagcgggctggcaggcnccgatagnngnnngnnnnnnnnnnnnnnnnn

SEQ ID NO: 143750 - DNA, 742 bp, Homo sapiens
  misc_feature: GYAE6OF02G5MUP.44.42.D09.1.454.CMB.1.raw
  modified_base (189)..(189): a, c, t, g, unknown or other
  misc_feature (189)..(189): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcactcaggacacagggtcctgggcccagtctgccctgactcagccctccctcgcgtccgggtntgtcggtcagtcagtccaccatcctctgcactcggaaccagactaatttcattaggtaactcatgactatcgtctccgtcggtaccagctactaccgaccacggcaccaccgacccccagtacctcgtgttagttttggacgtacaaacgtaacgccgccccgtacggtaccggggtcccgtagttccggttcgtacgtcggtacctaccgtaacgtcgtacggaccaaccgtaccggtccctccgtcgtacccgttcgtccggtaccggtcctaccgacggtacttcggaaccgtagtacggtaacgtcgttagttaacgttttacgttacgtacgtaccgtacgtaccgttaccggtaagtccggggtaaccgtacctaaccgttagttacgtttacggttttaccggttccgggttttaccgggaccgggttacggaaccgttacgggtaacccgtacggttaaccccggttacggttaccgggtaccgaacccggttacccggtaaccggttaccccggtcccgggttacccccggtacggttaccccg

SEQ ID NO: 143751 - DNA, 685 bp, Homo sapiens
  misc_feature: GYAE6OF02H5I88.44.42.D09.1.454.CMB.1.raw
  modified_base (122)..(122): a, c, t, g, unknown or other
  misc_feature (122)..(122): n is a, c, g, or t
  modified_base (136)..(136): a, c, t, g, unknown or other
  misc_feature (136)..(136): n is a, c, g, or t
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
tcagacagtatatacacgaccggtgctcgatttagacacatacgcagggaaagggggggtcacaagaggcagcgctctcgggacgtctccaccatggcctgggctctgctgctcctcactcnctcaccaggacacnggtcctgggcccagtctgcctgactcagcctgcctcgtgtcgtgggcncctggacagtcgtcacntctcctgcagtggacnccagtcgtaatnttcttagtcttattgtctctgtactcaactatcactcaaggtaacgaccccaaactcactcattctatcgagtcctaagtacgacgtcctcgtacgggtttacacgtaccgtctctacgtcaccgttacgacgtacccggacgaaaccgccgtacccgtccgtagtaccaactttcgtccgtcggtccctaccggaacggtcctcgggaacggacggtacggtcgttacgttaagtttattaacgttttcgcgtttactaacgtacgtagtttacggttccgtacgctttacgtacgtttaactttacgtttaccgggtacgtttaacggggtaacggttaccgggtaaccgttaccggttaccgtcccggtttaaccggtacggttaccgtacccgaccccggtaacccgtccccgtaaacccccgttaggtacccgttccgtacgtttccccgg

SEQ ID NO: 143752 - DNA, 484 bp, Homo sapiens
  misc_feature: GYAE6OF02IJKNN.44.42.D09.1.454.CMB.1.raw
  modified_base (339)..(339): a, c, t, g, unknown or other
  misc_feature (339)..(339): n is a, c, g, or t
  modified_base (401)..(401): a, c, t, g, unknown or other
  misc_feature (401)..(401): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
  modified_base (461)..(484): a, c, t, g, unknown or other
  misc_feature (461)..(484): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcaactggctcgacccgtggggccagggaaccctggtccaccgtcctcctcgacgcctccaccgaacgggcccacgtccggtaccttccccccgnggcccaccccttcctaccaacgacgccaccttccgtggggccacgcggccgcccgtgggccngccgtggcaggtctacttctactatactntctgcggcggcgtggcgaacgcgcagagncnnnnnnnnnnnnnnnnnnnnnnnn

SEQ ID NO: 143753 - DNA, 743 bp, Homo sapiens
  misc_feature: GYAE6OF02G7RSN.44.42.D09.1.454.CMB.1.raw
  modified_base (119)..(119): a, c, t, g, unknown or other
  misc_feature (119)..(119): n is a, c, g, or t
  modified_base (127)..(127): a, c, t, g, unknown or other
  misc_feature (127)..(127): n is a, c, g, or t
  modified_base (275)..(275): a, c, t, g, unknown or other
  misc_feature (275)..(275): n is a, c, g, or t
  modified_base (602)..(602): a, c, t, g, unknown or other
  misc_feature (602)..(602): n is a, c, g, or t
tcagacagtatatacacgaccggtgctcgatttagacacatacgcaggggaaaggggggggtcacaagaggcagcgctctcgggacgtctccaccatggcctgggctctgctgctcctnactctccncactcaggacacgagggtcctcgggcccagtctcgcccgtgacctcgacgtcctacgcctaccggttgtccgttgggtactcccgtaggacctaggttccatcctaccttccgtcctgaccacgttacggacctcgacgcctaggttnaaccggtcctaacgtaacttacgttaagtcgtacctccgttaccgtaggttaacctaccgaaacaacgtaccgtaccccggaacccctaaaccccctaactcctacgtacttcacgtaactaactctacgtacgccggtccttggtacgttacttcgatctacgtcttacgtcgtcggtctacggccggtacaccgtaacgtcccgtaccctccgtaacgaccgttacgtcgtcgggttacccggtctcccggtaacggccgttaagggaaccgggttacgtaacgtaatttacgtttacgttacttccttacgaattaccgtaacngtttccgttaacgtttcggttcgggtttcggccgttcgggaacgggtccgacgtcgtccggtactcgggtaaccttcgaaccgttccggtacgtcccggtaccccgttaccggtacctcgtccctttccggaccttccccg

SEQ ID NO: 143754 - DNA, 534 bp, Homo sapiens
  misc_feature: GYAE6OF02ITBLT.44.42.D09.1.454.CMB.1.raw
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (492)..(493): a, c, t, g, unknown or other
  misc_feature (492)..(493): n is a, c, g, or t
  modified_base (495)..(498): a, c, t, g, unknown or other
  misc_feature (495)..(498): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
  modified_base (509)..(511): a, c, t, g, unknown or other
  misc_feature (509)..(511): n is a, c, g, or t
  modified_base (513)..(515): a, c, t, g, unknown or other
  misc_feature (513)..(515): n is a, c, g, or t
  modified_base (519)..(534): a, c, t, g, unknown or other
  misc_feature (519)..(534): n is a, c, g, or t
tcagacagtatatacacgaccggtgctcgatttagacacatacgcagggaaagggactggagtggattgggcgcatctataacagtggcagcaccaactacaaccccgccctcaagagtcgagtcaccatgtcactagacaggtccaagaaccagttctccctgaaattgacttctgtgaccgcgcggacacggccgtatattattgtgcgagagacttctatcgatacagtagaggcggggggcaatggctcgaccctgggccaggaccctggccaccgtctctcngcctccaccgaacggcccatcggtccttccccngccacctcctccaacgngcaccgtcgtcggggcacaggccggtccctgggcctggtcccgttaggtaccgaacgtaccgttacctttaccgtacgtaactttaccttggtaccttggacggtccgggtcgtacggggacgaaccgggcgtaccgtaagttacggngcngtanncnnnncgncgngcncnnncnnncgcnnnnnnnnnnnnnnnn

SEQ ID NO: 143755 - DNA, 612 bp, Homo sapiens
  misc_feature: GYAE6OF02JSYLU.44.42.D09.1.454.CMB.1.raw
  modified_base (220)..(220): a, c, t, g, unknown or other
  misc_feature (220)..(220): n is a, c, g, or t
  modified_base (309)..(309): a, c, t, g, unknown or other
  misc_feature (309)..(309): n is a, c, g, or t
  modified_base (576)..(578): a, c, t, g, unknown or other
  misc_feature (576)..(578): n is a, c, g, or t
  modified_base (582)..(582): a, c, t, g, unknown or other
  misc_feature (582)..(582): n is a, c, g, or t
  modified_base (584)..(585): a, c, t, g, unknown or other
  misc_feature (584)..(585): n is a, c, g, or t
  modified_base (587)..(612): a, c, t, g, unknown or other
  misc_feature (587)..(612): n is a, c, g, or t
tcagacagtatatacacgaccggtgctcgatttagacacatacgcagggaaagggactggagtggattgggcgcatctataacagtggcagcaccaactacaaccccgccctcaagagtcgagtccaccatgtcactagacaggtccaagaaccagttcctccctagtaaattgacttctgtgaccgccgcgacacggccgtatattatgtgcgagagtnttcctatccgaatacagtagaggacgggggggcgaactggcctaccgaccccgtggggacgacgggaaccctgggtacctaccggtccncctacgcgccctaccgaccgaacggccccacgtcgtcccgttccccctacggtcccaaccccgtcctaccaagacctacccgaccgttccggtcggggaccaccgaccggtcccgggcccggtacggggtctacccgggtcctcgggtaactaacggggaacctttaccgtttacccctaagttacttacgtttcggttaccgacggtagacccgggggtcttaagggacccgtaaagggccgaacgtaagttaccggatcaagcgnnncgcngnngnnnnnnnnnnnnnnnnnnnnnnnnnn

SEQ ID NO: 143756 - DNA, 768 bp, Homo sapiens
  misc_feature: GYAE6OF02GV09Y.44.42.D09.1.454.CMB.1.raw
  modified_base (197)..(197): a, c, t, g, unknown or other
  misc_feature (197)..(197): n is a, c, g, or t
  modified_base (718)..(718): a, c, t, g, unknown or other
  misc_feature (718)..(718): n is a, c, g, or t
tcagacagtatatacacgaccggtgctcgatttagacacatacgcagggaaaggggggggtcacaagaggcagcgctctcgggacgtctccaccatggcctgggctctgctgcctcctcactctacctcactcaggacacgagggtcctgggcccagtctgccctgactcacgcctgcctcgtcgtctggtctccgnggactgtcgatccactactcctcctgacacgttggccagacatcgactagtcggatataacttactctctccgtgtaactacaactaacgtactaccgacggtacaaacccgacccctaactctagttacttttgacgtaccgtgacgtcggacggtccgttacgtacggtttcgtttaccgtaacgtccgttacctttccgtcggttaccggtaccttaacccgtaggttaccgtacccgggacccttaaccggtcccgggtccctttaccgttcggtacctaaccgttcccgtttcgggtccggtacccgttcccgggtagttaccggggacggtaccgggtaccgtacgttaccggttaacgttacgtttaaccggcggtacccgggtacttaacgtaaaccgtaagttaaccgggtaaggttacgtaaacccgtttctttaaacgggtccgttcgaaccgggttctaaccgggtaccgtacgtaccggtaccggttacccggtacccgtaccggtanaaccccggacggtaccggtcccgtttaccccggcccggtacccgttaccg

SEQ ID NO: 143757 - DNA, 488 bp, Homo sapiens
  misc_feature: GYAE6OF01CXS5S.43.71.G05.1.454.CMB.1.raw
  modified_base (481)..(488): a, c, t, g, unknown or other
  misc_feature (481)..(488): n is a, c, g, or t
tcagtgtgagtagtcacgaccggtgctcgatttagtgtcgtcgcaagagagagggggagagggaaccatggaaacccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgattttgcagttgtattactgtcagcagtatggtaagctcaaccgatcaccttcggccaagggacacgactggagattaaccgaatgtgctgcacatctgtcttcattcttcccgcatctagaactactcactactcgagcgggctggaccgaaggcgcatacgnnnnnnnn

SEQ ID NO: 143758 - DNA, 485 bp, Homo sapiens
  misc_feature: GYAE6OF01BG9YD.43.71.G05.1.454.CMB.1.raw
  modified_base (475)..(475): a, c, t, g, unknown or other
  misc_feature (475)..(475): n is a, c, g, or t
  modified_base (478)..(485): a, c, t, g, unknown or other
  misc_feature (478)..(485): n is a, c, g, or t
tcagtgtgagtagtcacgaccggtgctcgatttagtgtcgtcgcaagagagagggggagagggaaccatggaaacccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggtccaacgggacgacgactggagattaaccgaactgtggctgcaccatctgtcttcatcttccgccatctgtaactactcacactgacgcggctggcgaacggcgcanagnnnnnnnn

SEQ ID NO: 143759 - DNA, 477 bp, Homo sapiens
  misc_feature: GYAE6OF01B35YO.43.71.G05.1.454.CMB.1.raw
  modified_base (470)..(477): a, c, t, g, unknown or other
  misc_feature (470)..(477): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgctagtgtattactgtcagcagtatggtagctcaccgatcaccttcggccaagggacacgactggagattaaccgaactgtgctgcacatctgtcttcatcttcccgcatctgaactactcacactgagcggctggcaaggcgcatgnnnnnnnn

SEQ ID NO: 143760 - DNA, 479 bp, Homo sapiens
  misc_feature: GYAE6OF01C92QP.43.71.G05.1.454.CMB.1.raw
  modified_base (472)..(479): a, c, t, g, unknown or other
  misc_feature (472)..(479): n is a, c, g, or t
tcagtgtgagtagtcacgaccggtgctcgatttagtgtcgtcgcaagagagagggggagagggaaccatggaaaccccagcgcagcttctcttcctcctgctactctggctcccagggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtgctgcacatctgtcttcatcttcccgcatctgaactactcacactgagcgggctggcaaggcgacatacgnnnnnnnn

SEQ ID NO: 143761 - DNA, 481 bp, Homo sapiens
  misc_feature: GYAE6OF01DDOAV.43.71.G05.1.454.CMB.1.raw
  modified_base (470)..(470): a, c, t, g, unknown or other
  misc_feature (470)..(470): n is a, c, g, or t
  modified_base (474)..(481): a, c, t, g, unknown or other
  misc_feature (474)..(481): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcactcttcccgccatcctgactactcaaactgagcgggctggcaaggcanatgnnnnnnnn

SEQ ID NO: 143762 - DNA, 485 bp, Homo sapiens
  misc_feature: GYAE6OF01DX6AI.43.71.G05.1.454.CMB.1.raw
  modified_base (476)..(476): a, c, t, g, unknown or other
  misc_feature (476)..(476): n is a, c, g, or t
  modified_base (479)..(485): a, c, t, g, unknown or other
  misc_feature (479)..(485): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcacgatcaccttcggccaagggacacgactggagattaaccgaatgtgctgcacatctgtcttcatccttcccgctatctacgtaactactcactactgacgcgggctggcaaggcgacatgngcnnnnnnn

SEQ ID NO: 143763 - DNA, 515 bp, Homo sapiens
  misc_feature: GYAE6OF01AZ5F5.43.71.G05.1.454.CMB.1.raw
  modified_base (468)..(468): a, c, t, g, unknown or other
  misc_feature (468)..(468): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattgggagtatttaccacagtgggagcacctactacaacccgtccctacaaaagtcgaggcaccatactccgtagacacgtaccaagaaccaattcctccctgaaacgctagagctctgtcgaccgccgcagacacggctgtctattactgtcgcgacggccccgagcgcngtggtcttttgatgcctttgattagtgtcgggacaagggcaagtcgg

SEQ ID NO: 143764 - DNA, 626 bp, Homo sapiens
  misc_feature: GYAE6OF01BMT9S.43.71.G05.1.454.CMB.1.raw
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
tcagtgtgagtagtcacgaccggtgctcgatttagtgtcgtcgcaagagagagggggagagggaaccatggaaacccagcgcagcttctcttcctcctgctactctggctccaggggaaagagccaccttctcctgcaggtccagtcagagtcttaccaacgactacttagcctggtaccatcagaaacctggccaggctcccgaggctcctcagtctacggtgcatccagcagggccatggcatcccagacaggttcagtggcaggtggtctgggacagacttcactctcaccgtcagcagactcggacctgaacgtatttgcgtagtgtattactgtcagcagtagtggtagctcaaccgatcctaccgttcggaccgaacgggaccacggaacgtacgggaagtaacttaaaccggaactggtcgggtactaggaccaaccgtatacgttacggttaccttactaacgttcctttccccggacctaacgttacctaacggtaaacccttaaccgttaccaaccgtaccgtacggtaaccgggtaccggggtaccgttacggggacccgtaaacggggtccggaacccggttaagttaacggagacgagacgtaggcgngngtg

SEQ ID NO: 143765 - DNA, 485 bp, Homo sapiens
  misc_feature: GYAE6OF01A0RSP.43.71.G05.1.454.CMB.1.raw
  modified_base (478)..(485): a, c, t, g, unknown or other
  misc_feature (478)..(485): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgattttgcagtgtattactgtcagcagtatggtagctcaccgatcacctttcggccaagggacacgactggagattaaccgaatgtggctgcaccatctgtcttcatccttcccgccatctgaactactcacactgagcgggctgggctaagggcgcatgnnnnnnnn

SEQ ID NO: 143766 - DNA, 487 bp, Homo sapiens
  misc_feature: GYAE6OF01BSCIA.43.71.G05.1.454.CMB.1.raw
  modified_base (439)..(439): a, c, t, g, unknown or other
  misc_feature (439)..(439): n is a, c, g, or t
  modified_base (479)..(487): a, c, t, g, unknown or other
  misc_feature (479)..(487): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatccttcccgcctatctntaacctctcacactgacgcgggctggcgaaggcgcatagnnnnnnnnn

SEQ ID NO: 143767 - DNA, 514 bp, Homo sapiens
  misc_feature: GYAE6OF01D1PDG.43.71.G05.1.454.CMB.1.raw
  modified_base (507)..(507): a, c, t, g, unknown or other
  misc_feature (507)..(507): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaagggctgggagtggattgggagtatttaccacagtgggagcacctactacaacccgtcctacaaaagtcgaggcaccatatccgtagacacgtccaagaaccaattctcctgaacgctagagctctgtcgacccgccgcagacacggctgtactattactgtgcgacggccccgagcgcagtggtcttttgatgtcctttgatagtggtaggggaccaaggganaagtcgg

SEQ ID NO: 143768 - DNA, 549 bp, Homo sapiens
  misc_feature: GYAE6OF01EAILX.43.71.G05.1.454.CMB.1.raw
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (543)..(543): a, c, t, g, unknown or other
  misc_feature (543)..(543): n is a, c, g, or t
tcagtgtgagtagtcacgaccggtgctcgatttagtgtcgtcgcaagagagagggggagacgggaaccatggaaacccagcgcagtcttctcttcctcctgctactctggactcccaggggaaagagccaccttctcctgtcaggtccagtctagagtcttaccaacgtactacttagcctggtaccatacagaaacctggccagggctccgaagggctcctcatctacggtgcatccagcaggccactggcatcccagacaggttcagtggcagtgggtctggganagacttcacgtctcacgtcagcagctggaccctggagattttgctagtgtattacnggtcagtctagtatggtagtctcaccgatcgtaccttcggccaaagggccacgactggacgagttaaaccgaactcggtacggactacgcaccgtattcttgttacttcacttccgtcccgacctatcgtagaacttactcaactctggagtcgggcgtgggaccgaagggtccgacgtactaaggctacgtgatagcgngcgtcg

SEQ ID NO: 143769 - DNA, 578 bp, Homo sapiens
  misc_feature: GYAE6OF01BJ8AD.43.71.G05.1.454.CMB.1.raw
  modified_base (567)..(567): a, c, t, g, unknown or other
  misc_feature (567)..(567): n is a, c, g, or t
  modified_base (571)..(573): a, c, t, g, unknown or other
  misc_feature (571)..(573): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccacgtggcatcccagacaggttcagtggcagtgggtcgtgggacagacttcactctcaccgtcagcagacgtcggaaccctgaagtattttgctagttgttattactgtcagcagttagtggtagctcgaaccgatccgaccttccggaccgaagggacacgacgtggaacgtaacttaaccgaactggtacggtcgtacgcctaacctattcgtcgttccttctacttcccttcccgacctacttccgttacgtaaccttacctacctaacgtaccgtacggacggtccgggtcgttacgggaccggaacgggtcccgacgtaagtagncgannncnngn

SEQ ID NO: 143770 - DNA, 482 bp, Homo sapiens
  misc_feature: GYAE6OF01CT41Q.43.71.G05.1.454.CMB.1.raw
  modified_base (448)..(448): a, c, t, g, unknown or other
  misc_feature (448)..(448): n is a, c, g, or t
  modified_base (469)..(469): a, c, t, g, unknown or other
  misc_feature (469)..(469): n is a, c, g, or t
  modified_base (473)..(476): a, c, t, g, unknown or other
  misc_feature (473)..(476): n is a, c, g, or t
  modified_base (478)..(482): a, c, t, g, unknown or other
  misc_feature (478)..(482): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgtattttgactagtgtattatgtcagcagtagtgtagtcacgatcacttcggactaagggacacgactggagtacttaacgaactgtgctgcacatctgtcttcatcctccgctatctcgaactactcacnctgacgcggctggcacggcanatgnnnnannnnn

SEQ ID NO: 143771 - DNA, 495 bp, Homo sapiens
  misc_feature: GYAE6OF01DRR4G.43.71.G05.1.454.CMB.1.raw
  modified_base (329)..(329): a, c, t, g, unknown or other
  misc_feature (329)..(329): n is a, c, g, or t
  modified_base (482)..(482): a, c, t, g, unknown or other
  misc_feature (482)..(482): n is a, c, g, or t
  modified_base (486)..(489): a, c, t, g, unknown or other
  misc_feature (486)..(489): n is a, c, g, or t
  modified_base (491)..(491): a, c, t, g, unknown or other
  misc_feature (491)..(491): n is a, c, g, or t
  modified_base (493)..(495): a, c, t, g, unknown or other
  misc_feature (493)..(495): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgctagtntattactgtcagcagtatggtagctcacgatccaccttcggacaagggacacgacgtggaagacttaaaccgaactggtacggctgcaccgatctgtcttcactctcccgcatctagtacctactcacactgagcgggctggacgaaggcacntagnnnnancnnn

SEQ ID NO: 143772 - DNA, 552 bp, Homo sapiens
  misc_feature: GYAE6OF01BVC6J.43.71.G05.1.454.CMB.1.raw
  modified_base (544)..(547): a, c, t, g, unknown or other
  misc_feature (544)..(547): n is a, c, g, or t
  modified_base (549)..(552): a, c, t, g, unknown or other
  misc_feature (549)..(552): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtgcagtgggtctgggacagacttcactctcaccgtcagcagactggaccctgaagtagttttgctagttgtatttactgtacagcgtagtagtggtagctacaccgtatcctaccgttcggaccgaagggaccacgtacgtaggaacgtaacgttaaccgacgtaggtcggctagacactatcgttgtccttactacttcccgttcccgcctacttcctacgtaaccttacctaccaactactacggtacggccggcgtacggacgaacgggtcgactagtagnnnnannnn

SEQ ID NO: 143773 - DNA, 483 bp, Homo sapiens
  misc_feature: GYAE6OF01E5I04.43.71.G05.1.454.CMB.1.raw
  modified_base (352)..(352): a, c, t, g, unknown or other
  misc_feature (352)..(352): n is a, c, g, or t
  modified_base (415)..(415): a, c, t, g, unknown or other
  misc_feature (415)..(415): n is a, c, g, or t
  modified_base (475)..(475): a, c, t, g, unknown or other
  misc_feature (475)..(475): n is a, c, g, or t
  modified_base (477)..(483): a, c, t, g, unknown or other
  misc_feature (477)..(483): n is a, c, g, or t
tcagtgtgagtagtcacgaccggtgctcgatttagtgtcgtcgcaagagagagggggagagggaaccatggaaacccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagtattttgctagtgtattactgtcagcagtatggtanctcaccgatccacttcggccgaagggacacgactggacgattaaccgatgtgctgcacatctntcttcactctcccgctatctgactactcacactgagcgggctggcgaaggcgacagtagnannnnnnn

SEQ ID NO: 143774 - DNA, 472 bp, Homo sapiens
  misc_feature: GYAE6OF01CJENF.43.71.G05.1.454.CMB.1.raw
  modified_base (466)..(472): a, c, t, g, unknown or other
  misc_feature (466)..(472): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatgtagctcacgatcacttcggcaagggcacgatggagattaacgaactgtggctgcaccatctgtctcatccttcccgcatctgtaactactcacactgagcggctggcaaggcacatagnnnnnnn

SEQ ID NO: 143775 - DNA, 559 bp, Homo sapiens
  misc_feature: GYAE6OF01D0DIF.43.71.G05.1.454.CMB.1.raw
  modified_base (225)..(225): a, c, t, g, unknown or other
  misc_feature (225)..(225): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtncatccagcagggccactggcatcccagacaggttcagtggcagtgggtctgggacagacttcactctcaccgtcagcagactggaccctgaacgtattttgctagtgtatttactgtcagctagtagtggtagctcaccgatccaccgttcggacaagggacacgacgtggaacgtaattaaccgaacgtggtcggctgaccactactctcgttcttctacttccttcccgacctacttcctacgtaaaccttacctcctaaccgtacgtcggaaccggccggggtccgtacgggacgaacgggccacgtaagttacggnagtcngancngngn

SEQ ID NO: 143776 - DNA, 662 bp, Homo sapiens
  misc_feature: GYAE6OF01CVUF2.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactcccgccacgcccccgaaggggaacgggctggagtggacgtttgggattagtttaaccgacgtaggtcgggaacgccgtaacctacgtaaccgaaaccccgtcccctaacgaaaacgtccggaacggaccaaccgaataacgtacccggtaagacctaaccgtaccaaacgtaaaccctaactttacctaccctaggaacgtcgtacgaacgtccgtacgttagtcggtacccgccgaccaacgaccgacggtcgttacgtacttacgtttacgtggttcgcggaccggccccgaggccgacgtacggttggttaccgtttttagacgttcggttccgtttagtacgttagttcgggttacggggacccgaaacgggtacgtaaggttcccggg

SEQ ID NO: 143777 - DNA, 699 bp, Homo sapiens
  misc_feature: GYAE6OF01D1YJO.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagttacttacttcgtggggctggactccgccacgcccccgaggggaacgggctggagtggagttgggagttagtttaccgacgtaggtgggacgcacctaactaaccaacccgtccctaacgaaaacgtcgaacggaccaacctatacgtaccgtaacgacctaccgtaccaaacgaaccctaattccctacccgtagaaacgtctacggaacgtccttcgtcggtacgacccgtcccgactaacggaccgtaccgggtcttacgttacctttaacgtttaccgttcggttacggaccggtaacccgggcccccggtaacggcccggtaccgtaaggtttccgggtttaccgtttttttacggacgttttcggttcccgtttttaggtaacgtttacgggttcggggttaccgggggtaacccgtaaagggggttaaccgtaaacggttacccggg

SEQ ID NO: 143778 - DNA, 548 bp, Homo sapiens
  misc_feature: GYAE6OF01C60LT.43.71.G05.1.454.CMB.1.raw
  modified_base (420)..(420): a, c, t, g, unknown or other
  misc_feature (420)..(420): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccacgcccccgagggaggggctggagtggattgggagtatttaccgacgaggtgggagcaacctactaccaacccgtcctacaaaagtcgaggcaccatatccgtagacacgtaccaagaaccctaacttcctccctagaacgcgtagancctcgtgtcgacccgccgcagaccacgctcgtacttagttacgtgtgcgacggcccgagccgctaggtcggttcgttttgattcgtcctttgattagtcggtacgggaccgaagggtaccgagttcgg

SEQ ID NO: 143779 - DNA, 489 bp, Homo sapiens
  misc_feature: GYAE6OF01ELZHL.43.71.G05.1.454.CMB.1.raw
  modified_base (475)..(475): a, c, t, g, unknown or other
  misc_feature (475)..(475): n is a, c, g, or t
  modified_base (481)..(489): a, c, t, g, unknown or other
  misc_feature (481)..(489): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaaccgaactgtggctgcaccatctgtcttcacttccttcccgcctatctagaacctactcacactgagcgggctggcaaggcncatagnnnnnnnnn

SEQ ID NO: 143780 - DNA, 323 bp, Homo sapiens
  misc_feature: GYAE6OF01DDNAL.43.71.G05.1.454.CMB.1.raw
  modified_base (227)..(227): a, c, t, g, unknown or other
  misc_feature (227)..(227): n is a, c, g, or t
  modified_base (313)..(323): a, c, t, g, unknown or other
  misc_feature (313)..(323): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaggggaaagacgccaccttctcctgcaggtccagtcagagtcttaccaacgactacttagcctggtaccatcagaaacctggccaggcctcccaggctcctcatctacggtncactccagcagggccactggcatcccagacaggttcagtagcaggtggtctaggacagacttcactctcacgtcagcacgtacggnnnnnnnnnnn

SEQ ID NO: 143781 - DNA, 621 bp, Homo sapiens
  misc_feature: GYAE6OF01E1T02.43.71.G05.1.454.CMB.1.raw
  modified_base (126)..(126): a, c, t, g, unknown or other
  misc_feature (126)..(126): n is a, c, g, or t
  modified_base (324)..(324): a, c, t, g, unknown or other
  misc_feature (324)..(324): n is a, c, g, or t
  modified_base (616)..(616): a, c, t, g, unknown or other
  misc_feature (616)..(616): n is a, c, g, or t
  modified_base (618)..(621): a, c, t, g, unknown or other
  misc_feature (618)..(621): n is a, c, g, or t
tcagtgtgagtagtcacgaccggtgctcgatttagtgtcgtcgcaagagagaggggggagagggaaccatggaaaccccagcgcagcttctcttcctcctgctactctggctcccgaggggaaagngcccaccttctcctgcaggtccagtcagagtcttaaccaacgactacttagcctggtaccatcaacgaaaccgtggccaggcctcccgaggcctcctacagtctacggtgccatccaggccaggccactggccatcccaggtaccaggttcgagtggcgagtggggtctgggactagacttcactctcaccgtcagcngacctggacctagtaagtatttgcgtagttagtattacgtgtcagctagtagtgtacgctacaccgtactcgtaccgttacgggaccgaaacgggacacgtaacgtaggtaacgtaacgttaaaccggaacgttggtacggccgtacgacctacctacgttcttcgttaccttaccttaccttcccgttaccccgacctacttaccgttaacgtaacccttaacctacctaaccgacgtcggtacggccgggtaccgtaccgggacgaacggtacgaacgagtacgtcagcnannnn

SEQ ID NO: 143782 - DNA, 569 bp, Homo sapiens
  misc_feature: GYAE6OF01A5851.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggactccgccacgcccccgagggaaggggctggagtggattgggagtatttaccacgagtgggagccaaccgtactaaccaacccgtccctacaaaagtcgaggcaaccatactccgtagacacgtaccaacgaacctaacttcctacctagaaagcctagacgcttctgtcgacccgccgcacgacacggctcgtactagttacgtgtcgacgacggaccccgagccgacgacgtggtccgttttgacttggttcccttgaactacgttggtacggggaccaaacggggtactaaggttacggg

SEQ ID NO: 143783 - DNA, 494 bp, Homo sapiens
  misc_feature: GYAE6OF01A22J0.43.71.G05.1.454.CMB.1.raw
  modified_base (470)..(470): a, c, t, g, unknown or other
  misc_feature (470)..(470): n is a, c, g, or t
  modified_base (486)..(494): a, c, t, g, unknown or other
  misc_feature (486)..(494): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgattttgctagtgtattactgtcagcagtatggtagctcaccgatcaccgttcggccaagggacacgactggagattaaccgaactgtggctgcacctatctgtcttcactccttcccgctatcctacgtaaccttctcacactgacgcggcnggacgacggcgcatgnnnnnnnnn

SEQ ID NO: 143784 - DNA, 521 bp, Homo sapiens
  misc_feature: GYAE6OF01DTY41.43.71.G05.1.454.CMB.1.raw
  modified_base (455)..(455): a, c, t, g, unknown or other
  misc_feature (455)..(455): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (515)..(521): a, c, t, g, unknown or other
  misc_feature (515)..(521): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagaccaggttcagtggcagtgggtctgggacagacttcactctcaccgtcagcagactcggaccctagagtattttgctagtgtattactgtcagactagtatggtagctcgaccgatccaccgttccggaccgaacgggacacgacgtaggaacgtaacttaaccgaacgtgtggctagcacctatctgtcttcacttcctcccnctactctacgtaacctactcactactgacggcgggctcggacgaacggcgacanacgncnnnnnnn

SEQ ID NO: 143785 - DNA, 522 bp, Homo sapiens
  misc_feature: GYAE6OF01CWIL4.43.71.G05.1.454.CMB.1.raw
  modified_base (224)..(224): a, c, t, g, unknown or other
  misc_feature (224)..(224): n is a, c, g, or t
  modified_base (514)..(515): a, c, t, g, unknown or other
  misc_feature (514)..(515): n is a, c, g, or t
  modified_base (517)..(517): a, c, t, g, unknown or other
  misc_feature (517)..(517): n is a, c, g, or t
  modified_base (519)..(522): a, c, t, g, unknown or other
  misc_feature (519)..(522): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtncatccagcagggccactggcatcccagacaggttcagtggcagtgggtctgggacagacttcactctcaccgtcagcagactcggaccctgaagtattttgctagtgtattactgtcagctagtatggtagctcaccgtatcaccttcggaccaagggacacgacgtggagtaactaaccgaactggtgctgacactatctcgttcttcacttccttccgacctattcctacgtaacctactacctacacgtcgacggccgggcgtacggcgaacggccgcgtacgtagnncnannnn

SEQ ID NO: 143786 - DNA, 789 bp, Homo sapiens
  misc_feature: GYAE6OF01CSUUP.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtcccctcacctgccactgtctcgtggtgctccatcagcagcagttacttacttcgtggggctggactccgccacggcccccggaaggggaacggggcgtagggaggtggagttgggaagttactttaccgaacgaggtggggacgcctaaccttactaaccgtaaaccccgttacccgtaaccgaaaaacggttaccggaacggcctaaacccgtacttaaacgttacccggtaacgaacccgtaaccggttacccaaaacggtaaacccctaaaccgtttaccctacccccgttaagaaaccggtccgttaaggtaaccggtccgtttaccgtagggttacccggaacccccggacccgaaccgaaccggtaaccaacccggggtccttacgttaccttaacgtttaaccgtcggttaccggaccggtacccgggccccggaacggtcccggtacgtaacgggttcggtttaccgttttttacggacgtttaccggttcccgtttttagtaaggtttacggttcggggttaacggggggtaacccgtaaaacgggggtaccgtaaacggggtttacccgggg

SEQ ID NO: 143787 - DNA, 707 bp, Homo sapiens
  misc_feature: GYAE6OF01B838K.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaacgcctttcggacgaccctgtccctcacctgcactgtctcgtggtcgctccatcagcagctacgtaccttacgttcgtggggtctcggactcccggccacggcccccggaggggaacgggctagggacgtcgggtagttggggaacttacttaccgacgtaggtcgggacgccaccgtactaaccgaacccgttccctaacgaaaacgtcgacggacctaactacgtacgtcggtaacaccgtaccgtaccgaaacgtaaccctaacgttcctacccgtacgaaacgtcgtacgacgtccttcgtcgtcgaacccgtccgacgtacgacgaccggtcttgtaccttacgttaccgtggttacgccgggaccggtccccgtaggcccgtcgtacgggttcggttccgttttttacgaaggtttccggttacccgttttagggttaaacgtttacgggttacgggggttacgggggtaaccccggtaaaacgggggtacccgtaaaggtttaccccgggg

SEQ ID NO: 143788 - DNA, 737 bp, Homo sapiens
  misc_feature: GYAE6OF01DMTYY.43.71.G05.1.454.CMB.1.raw
  modified_base (227)..(227): a, c, t, g, unknown or other
  misc_feature (227)..(227): n is a, c, g, or t
tcagtgtgagtagtcacgaccggtgctcgatttagtgtcgtcgcaagagagagggggatgctttctgagagtcatggatctcatgtgcaagaaaatgaagcacctgtggttctcctctgctggtggcgctcccagatgggtcctgtcccagctgcagctgcagggagtccgggcccaggacctgggtgaagtcccgttacggacgacccctgtcccctcaccgtgcncttgtctcgtggtcgacctcatcagcagctacgttacttacgttccgtggggcttaggaccgtcccgaccgaccggcccccgaggggaacgggtcgtgggaggtggtaggttggtacgttaacttaaccgacggtaggtagggacgacctaacccgttaacctaacccgtaaccccggttacccgtaacgtaaaacggtccggaacggtaccaacccgtaacgtaccgtaccgtaaacgaaccgtaccgtaaccgaaacggaaaccctaagtttacccgtacccgagtaacgtctacgtacgctacgtctaacggccccgtaccacgacggaacctccggacttcgttaacttacgttaccgtcgggtaccgtacccggaccgggtccccggtagcccggtacgtaaccgggtttggttaccgtttttgacggtttccgtttcccgtttagtacgttacgggttcgggttaaccgggaaccggtaaacggggtcctaaagggttcccggg

SEQ ID NO: 143789 - DNA, 654 bp, Homo sapiens
  misc_feature: GYAE6OF01DTEJT.43.71.G05.1.454.CMB.1.raw
  modified_base (123)..(123): a, c, t, g, unknown or other
  misc_feature (123)..(123): n is a, c, g, or t
  modified_base (230)..(230): a, c, t, g, unknown or other
  misc_feature (230)..(230): n is a, c, g, or t
  modified_base (336)..(336): a, c, t, g, unknown or other
  misc_feature (336)..(336): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaanagccaccttctcctgcaggtccagtcagagtcttaaccaacgactacttagcctaggtaccatcaagaaacctggccaggcctcccaggcctcctcatcgtacggtncactccagcgaggcctacgtggacactcccagacgtagttcgagtgcgtagtgggtctgggacagtacttcactcttcacgtcagactagactcggacctgtaatntttgactagttgttactacgtgtacagtcgtagttagtcggtacgcctaccgaacccgttagtaccctaccgggttacgaaccggaaacgggtaccacgtaacgttcgggaaagttaccgtttaaaccggacttgggtacgcttaccggacttacctaggtttccttacgttccttacttcccgttacccgtaccctacctaacgtttacccgtaacgtaaacccttaccaccgtaacgccgggttacggaccggggtcccgtacggaacggtaaccggaaccggtctaccgaagttagctacgagtgatctacgngn

SEQ ID NO: 143790 - DNA, 701 bp, Homo sapiens
  misc_feature: GYAE6OF01BKP0L.43.71.G05.1.454.CMB.1.raw
  modified_base (246)..(246): a, c, t, g, unknown or other
  misc_feature (246)..(246): n is a, c, g, or t
  modified_base (331)..(331): a, c, t, g, unknown or other
  misc_feature (331)..(331): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggacgtcgggcccaggactggtgaacgccttcggacgaccctgtcccctcacctgcctactgtctcgtggtcgctccatcngcagcagtacttacttcgtgggctggactccgccacgccccgagggacgggctggagtggtacgttgggtacttacgttaccagnggtagggacaccgtacctactaacccgtaacccgtaccctaacgaaaacggtcgaacggccaaccgtaattacgtaccgtaagaacccgtaacgtaaccaaacgtaacctaactttaccctccgtaagacgtcgtacgacgtccttcgtcgtacgaacccgtcgacgtaacgaccgaccggtcttacgttaccttattaccggtgttaccggccggaaccgggccccgtaggcccggtacgttacgggttccgggttttacgttttcgggacgttttccgggtttccgtttaagggtacggtttacgggttacgggggtacccgggggttaaaccggtaaacgggtaaacggttaacgggttaccccggg

SEQ ID NO: 143791 - DNA, 516 bp, Homo sapiens
  misc_feature: GYAE6OF01AFRDI.43.71.G05.1.454.CMB.1.raw
  modified_base (466)..(466): a, c, t, g, unknown or other
  misc_feature (466)..(466): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaacctggccaggctcccaggctcctcatctacggtgcatccagcagggccactggcatcccagacagttcagtgcagtggtctgggacagacttcactctcaccgtcagcagactggaccctgaagtagtttgcagtgtattactgtcagctagtactggtagctacacgatcgtaccttcggactacgggacacgactaggagacttaaccgactgtcgctagaccaccatcctagtcttcactccttccgctaactctacgtaactactcacgtacnggtacgcggtactgggacctaacggctacagtacgancagcatcncgtng

SEQ ID NO: 143792 - DNA, 667 bp, Homo sapiens
  misc_feature: GYAE6OF01EH0BL.43.71.G05.1.454.CMB.1.raw
tcagtgtgagtagtcacgaccggtgctcgatttagtgtcgtcgcaagagagagggggatgctttctgagagtcatggatctcatgtgacaagaaaatgaagcacctgtggttcttcctcctgctggtggcggctcccagatgggtcctgtcccagctgcagctgcaggacgtccgggcccaggactgggtagaacgtccttcggacgtacccttcgtccctcacctgccactgtctcgtggtcgctcatcagcagcagtacttacttcgtggggctggactccgccacgcccccgaggggacgggcgtggagtggagttgggagttattaccgactaggtgggacacctaacctaactaacccgtaacccgtaccctaacgaaagtcgacggaccactatactaccgtaagaccaccgtaccaaacgtaaaccctacttacctcctaagaacgtcctagacgtccctcgtaggtccggacccgcgacgtaacgaccgaccggtcttacgtccttaactttaccggtgtcgggtacccgaccggacccccggaggtccggacgttacggttggtttccgtttttacggagtttcggtacccgttttaggtaattaacggttcggggtacgggaacccggttaaaggggaactaagggtttaccccggg

SEQ ID NO: 143793 - DNA, 616 bp, Homo sapiens
  misc_feature: GYAE6OF01DGTIY.43.71.G05.1.454.CMB.1.raw
  modified_base (608)..(608): a, c, t, g, unknown or other
  misc_feature (608)..(608): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactcggaccctggaagtattttgctagtgtattactgtcagctagtatggtacgctacaccgatcaccgttcggaccgaacgggactaacggacgtagggaacgtaacttaaaccgaacgttggtaggtacctcggacctaaccgtacgttccttcggttacctttacgtaacttcccgtttccccgacctacgttacctacgtaaaccttacctacctaacgtacgttacgggaacggtccggggtaccgttacgggaccggtaaaccggggccgtaacgtaaacggttagagtacgtcgtanagcngngc

SEQ ID NO: 143794 - DNA, 625 bp, Homo sapiens
  misc_feature: GYAE6OF01ARVGI.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaacgccttcggacgacccctgtcccctcacctgcctactgtcttcgtggtcgctccatcagcagctacgttacttacgttcgtgggctaggctcccgccacggccccgaggggacggcgtggagtggacgttgggacttacgttaccgagaggtacgggacaccgtaacctaacctaaccgtaaccccgtacctaacgaaacggtcgaacgccaactactacgtaccgtacgaaccgtacgtaaccaaacgtaacctaacttccctaccgtagaactcgtacgactctcgtcgtcgacccgcgacgacgacacggtctacgtacttacgttacgtgtcgccgaccgcccgagcgtcgtaggtcggttacgttttaggctcggtttcttagtacgttaaggtccgggtagggtaaccgaacggtactacggtacccgg

SEQ ID NO: 143795 - DNA, 683 bp, Homo sapiens
  misc_feature: GYAE6OF01CS058.43.71.G05.1.454.CMB.1.raw
  modified_base (225)..(225): a, c, t, g, unknown or other
  misc_feature (225)..(225): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
tcagtgtgagtagtcacgaccggtgctcgatttagtgtcgtcgcaagagagagggggagagggaaccatggaaacccagcgcagcttctcttcctcctgctactctggctcccgaggggaaagagccaaccttctcctgcaggtccagtcagagtcttaccaacgactacttagcctggtaccatcagaaacctggccaggctcccaggctcctcatctacggtncatccagcagggccactggcactcccagacaggttcagtggcagtgggtctgggacagacttcactctcaccgtcagcagactcggaccctgaacgtattttggctagtaggttattacgtgtcgagacgtaagtagtgggtacgtcgtaccgaaccgtacttaccgtaacccgtttccgggacccgaaacgggaccaaccggtacgtacgggaacgtaacgtttaaaacccggaacgttagggtacggtaccgttacggaccgaaccctacgttccgttaccggtttacctttaccgtaaccgtttccccgttaccccggtaccctacgtttcccgtaaccgtaacctttaccgttacctaaccgtaccgtacggtaaccggtaccggggtaccgttacgggaaccggtaaacgggcccggtacgtaaacgtacggtacaccgtaagacancngngc

SEQ ID NO: 143796 - DNA, 536 bp, Homo sapiens
  misc_feature: GYAE6OF01BQ0R5.43.71.G05.1.454.CMB.1.raw
  modified_base (224)..(224): a, c, t, g, unknown or other
  misc_feature (224)..(224): n is a, c, g, or t
  modified_base (526)..(526): a, c, t, g, unknown or other
  misc_feature (526)..(526): n is a, c, g, or t
  modified_base (530)..(536): a, c, t, g, unknown or other
  misc_feature (530)..(536): n is a, c, g, or t
tcagtgtgagtagtcacgaccggtgctcgatttagtgtcgtcgcaagagagagggggagagggaaccatggaaaccccagcacagcttctcttcctcctgctactctggctcccaggggaaagagccaccttctcctgcaggtccagtcagagtcttaccaacgactacttagcctggtaccatcagaaacctggccaggctcccaggctcctcatctacggtncatccagcagggccactggcatcccagacaggttcagtggcagtgggtcgtgggacagacttcactctcaccgtcagcagactggaccctgaagtattttgctagtgtattactgtcagcagtagtggtagctcaccgtatccaccgttcggaccgaagggacacgacgtggaacgtaacttaaccgaactggtaggctacgcacctatctcgttccttcacttccttcccgcctactctacgtaacctacgtccactacgtaggacggcgggtactcgggacgaacgggcgacgaatacgnagtnnnnnnn

SEQ ID NO: 143797 - DNA, 633 bp, Homo sapiens
  misc_feature: GYAE6OF01BLIYS.43.71.G05.1.454.CMB.1.raw
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (362)..(362): a, c, t, g, unknown or other
  misc_feature (362)..(362): n is a, c, g, or t
  modified_base (619)..(619): a, c, t, g, unknown or other
  misc_feature (619)..(619): n is a, c, g, or t
  modified_base (626)..(626): a, c, t, g, unknown or other
  misc_feature (626)..(626): n is a, c, g, or t
  modified_base (629)..(630): a, c, t, g, unknown or other
  misc_feature (629)..(630): n is a, c, g, or t
  modified_base (632)..(632): a, c, t, g, unknown or other
  misc_feature (632)..(632): n is a, c, g, or t
tcagtgtgagtagtcacgaccggtgctcgatttagtgtcgtcgcaagagagagggggagagggaaccatggaaacccagcgcagcttctcttcctcctgctactctggctcccaggggaaagagccaccttctcctgcaggtccagtcagagtcttaccaacgactacttagcctggtaccatcagaaacctggcaggctcccaggctcctcatctacggtgcatccagcagggccactggcatcccagacaggttcagtggcagtgggtctgggacaggacttcactctctaccgtcagcacgacnggtacccngaagtacgttttgctacgtgtacttactcgtcagactagtatggtancgtcaccgatcctacgttcggacctaacgggacaaccggacgtggaacgtaactttaaaccggaacttacggtcgggtaacctacgggtaccaaccgtacgttaacgtttccgttaccttttacccgaactttcccgtttacccccggtacctaaactttccgtaaaccgttaaaccttaccgttacccgaaaccgttaccgtacggaacggtccgggaccgtacggggtaacgacggtacgacgtaacaggtaccncgtcacncgnngnc

SEQ ID NO: 143798 - DNA, 602 bp, Homo sapiens
  misc_feature: GYAE6OF01BWV9Y.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccagggactgggtgaagtcccttcggagaccccttgtcccctcacctgcctacttgtcctcgtgggtcggcctccatcagcagcagtacttacttcgtggggctggactccgccgacggcccccgaaggggaacgggcgtggaggtggagttgggagttactttaccgacgtaggtgggacgccaacctactaaccgaacccgtcctaacgaaaagtcgaaggcaaccatactccgtagacacgtaccaagtaacctaattcctacctagaacgtctagacgtcctctgtacgaccgccgacacgaccgacggtctcgtactattacgtgtcgccgaacgggtccccgaggccgcgtggttcggttcgttttggattcggtcgtttagatttcgtcggtacgggaccgaagggtactaaggttcgg

SEQ ID NO: 143799 - DNA, 636 bp, Homo sapiens
  misc_feature: GYAE6OF01CE7U7.43.71.G05.1.454.CMB.1.raw
  modified_base (628)..(628): a, c, t, g, unknown or other
  misc_feature (628)..(628): n is a, c, g, or t
tcagtgtgagtagtcacgaccggtgctcgatttagtgtcgtcgcaagagagagggggagagggaaccatggaaaccccagcgcagcttctcttcctcctgctactctggcctcccgaggggaaagagccaccttctcctgcaggtccagtcagagtcttaccaacgactacttagcctggtaccatcagaaactggccaggctcccaggctcctcatctacgtgcatccagcagggccactggcactcccagacagttcagtgcagtggtcgtggacagacttcactcgtcaccgtcagcagactcggacctagaacgtatttgactagtgtaattactgtcagtacgtagtagtggtacgcctaccgaacgtactaccgtaccgtttcggaaccgaacgggaccgtaacgtacgtaggaacgttaacgttaaaccggtaaacgttggtacgtacgtcggactaccgtagttaccgtacgttccgttacgtacttccccgttacccgtacttacgttaccgtacgtaaccttaccttaccgaacgtaccgttacgggacccggtacgggccggttacggtaccggaaacgggtcccggtaacgacggttaagcgttacgagtcacgtnacgtcgtg

SEQ ID NO: 143800 - DNA, 595 bp, Homo sapiens
  misc_feature: GYAE6OF01E1FTP.43.71.G05.1.454.CMB.1.raw
  modified_base (380)..(380): a, c, t, g, unknown or other
  misc_feature (380)..(380): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtcgctccatcagcagcagtaccttacttcgtggggctggactccgccacgcccccgaggggacgggctggagtggagttgggagttattaccgagaggtaggacgacacctactacaacccgtcctacgaaagtcgacgcacatactcganacacgtaccaagaacctaacttcctacctagaagcctagacgtctctagtacgaccgccacgacgaccgacgctagtactattaccgtgtcggaccggacggccccgaaggccgtcgtacgggttcgtttacgtttttcgagtttcggttccgtttagtaacgtttacggttcggggttacggggaaccggaaagggtaccgtaaggtttccggg

SEQ ID NO: 143801 - DNA, 672 bp, Homo sapiens
  misc_feature: GYAE6OF01DW5JV.43.71.G05.1.454.CMB.1.raw
  modified_base (329)..(329): a, c, t, g, unknown or other
  misc_feature (329)..(329): n is a, c, g, or t
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagttacttacttcgtgggctggactccgccgacgccccgagggacgggctggagtggagttgggattagttacacgagtggganctacctactacaacccgtcctaacaaagtcgacggtcaacatacgtaccgtagacaccgtacaaacgtaacctacttccgtacctagaaacgtcgtagacgtccgttcgtcggtaccgaccccgccgacgaacggaaccgtaccgggtacttacggttacctttaacgtttaaccgtcgggttaccgaccgggtaacccggacccccggtaggacccggtacgtacgggttcgggtttaccgttttttacgggagtttccggttaccgttttaagacgttttaacggttcgggggttaaccgggaacccggtaaaaggggttacccgtaaaggttacccgggg

SEQ ID NO: 143802 - DNA, 910 bp, Homo sapiens
  misc_feature: GYAE6OF01DUQ1T.43.71.G05.1.454.CMB.1.raw
  modified_base (146)..(146): a, c, t, g, unknown or other
  misc_feature (146)..(146): n is a, c, g, or t
tcagtgtgagtagtcacgaccggtgctcgatttagtgtcgtcgcaagagagagggggatgctttctgagagtcatggatctcatgtgacaaagaaaatgaagcaccttggttgttccttcctcctgcgtgggtggccgcctccagngtcgggtcctgtcccagctgcagctgcgaggtcgtccgggccaggctgggtagaacgtccgttcggactccctcgtcccctcacctgacctcgttcgtccgtcggtcggtcgtacctaccagtcgacgaccgacgtaccgttaacgtttacctttacggtttccgggtcggggtccgtacgggtcccgtaccccggaccccggtacccgggtacccccggggaaggggggtaacgggggtcggttacggggtacgggttagggttaacgggtttacgggttaacgtttaaccgtttaacccggaagggttacggggtaccgggtaacctaccgttaaaccccgttaaacccgttaaacccccggtaaccccgttaaccccgtaaacgtaaaaccgggtccggaaaccggtaccctaaaccgtaacgttaacccgtaaccggtaaccgtaaacccgtaacccgttaaaccgaaaccgttaacccttaacgtttccccgtaaccggttacggaaaccgtcggtacggtaccgttaccggttaccgtaccggtacccggacccggacccgtacgaaccggtaaccggtaccggtccgtttaacgttaccgttaacgttccggtacggtaccgggacccggtaccccggtaccgggacgtccggtacggttaccggttttgtttccgttttacgcgttttaccgttcgtttaggtaggtacgggttacggggtaacgggtaaccggtaacggtaacgttcgggtaccg

SEQ ID NO: 143803 - DNA, 529 bp, Homo sapiens
  misc_feature: GYAE6OF01EJY89.43.71.G05.1.454.CMB.1.raw
  modified_base (301)..(301): a, c, t, g, unknown or other
  misc_feature (301)..(301): n is a, c, g, or t
  modified_base (356)..(356): a, c, t, g, unknown or other
  misc_feature (356)..(356): n is a, c, g, or t
  modified_base (485)..(485): a, c, t, g, unknown or other
  misc_feature (485)..(485): n is a, c, g, or t
  modified_base (520)..(521): a, c, t, g, unknown or other
  misc_feature (520)..(521): n is a, c, g, or t
  modified_base (523)..(529): a, c, t, g, unknown or other
  misc_feature (523)..(529): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcactcccagaccagttcagtggcaggtgggtctgggacagacttcactctcaccgtcngcaggactggaccctgaagtattttgctagtgtattactgtcagcagtatggtanctcacgtactcctaccgttcggaccaagggacctaacgacgtaggagtattaaaccggaactggtggctgaccaccatctgttccttactacttccctcccgcctattctagtaacctctcacctacgngacgccggagcgggtacgacggtccgagtgtacgnngnnnnnnn

SEQ ID NO: 143804 - DNA, 685 bp, Homo sapiens
  misc_feature: GYAE6OF01ENZGJ.43.71.G05.1.454.CMB.1.raw
tcagtgtgagtagtcacgaccggtgctcgatttagtgtcgtcgcaagagagagggggatgctttctgagagtcatggatctcatgtgacaaagaaaatgaagcacctgtggttcttcctctgctggtggcgctccagatcggtcctgtcccagctgcagctgcaggcgtccggaccaggtactggtcgaacgccgttacggacaccccttcgtacccctacgacctgcctacgttcgtctcgtggtcgactccatcagcagctagtacttacgtcggtcggtctcgacgtccgccgaccggaccccggagggacggacgtggtagtaggtagttaggtatttacgttaccgagtggtacgggactacctaccgtaccgtaccgtaacccgtaccctaacgaagtcgacgtaccgactacgtacgtaccgtacgacctacgtacaaacgtacctacgttccgtaccgtagacgtcgtacgtacgtcgtcgtacggaccgacccgtcacgtacgaccgtacgtcgttacgttaccgttacgttcgtacggtccgaccggaccggtaccccggagggtacccgtacggttaggttacggttttaccgttttaggtacggtttccgttacggtttagtagttacgggttacgggaccgggtacggaaacggttacgtacggttacccgg

SEQ ID NO: 143805 - DNA, 681 bp, Homo sapiens
  misc_feature: GYAE6OF01DKCRW.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtccgggcccaggactgggtagaacgtccgttacggacgacccgttgtcccctcacctgcactgtctcgtggtcgctccatcagcagcagtaccttacttcgtgggctggactccgccacgccccggaaggggaagggctgggagtggagttagggtagttaacgtttaccaagtaggtagggacgcctaacctaccgtaacccgaacccgttaccctaacgaaaacgtcgaacggccaaccatacgtaccgtaagaccaacgtaccaaacgaacctaacttaccgtccgtaagaacgtctagacgccgttacgtcggtaccgacccgccggacaacggaccgtaccgggtcttacggttaccttaagtttaccgtggtaccggtacggaccgggtccccgaggcccgtacgtacgggttcggtttaccgtttttgacgtttcggttaccgttttaggtagttaacggttcggggtaacgggaccgtaaaacgggtcgtaaacggttcccgg

SEQ ID NO: 143806 - DNA, 557 bp, Homo sapiens
  misc_feature: GYAE6OF01BRCOC.43.71.G05.1.454.CMB.1.raw
  modified_base (468)..(468): a, c, t, g, unknown or other
  misc_feature (468)..(468): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
  modified_base (550)..(552): a, c, t, g, unknown or other
  misc_feature (550)..(552): n is a, c, g, or t
  modified_base (555)..(557): a, c, t, g, unknown or other
  misc_feature (555)..(557): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcaggtgggtctgggacagacttcactctcaccgtcagcacgacgtcggaccctgaagtattttgactagttgtattactgtcagctagtagttgtagctcacgtactcctaccgttaccggaccgaagggtacacggacgtaggagtaactaaccgaatggtcggctagaccacgtatcgttctccttactcttcccttcccnccttacttcctacgtaaccttactacctacctacgtcgacgggaccgggtctcgggaacgaacggtccgatacgtanacntnnnctnnn

SEQ ID NO: 143807 - DNA, 805 bp, Homo sapiens
  misc_feature: GYAE6OF01BT9HM.43.71.G05.1.454.CMB.1.raw
  modified_base (283)..(283): a, c, t, g, unknown or other
  misc_feature (283)..(283): n is a, c, g, or t
tcagtgtgagtagtcacgaccggtgctcgatttagtgtcgtcgcaagagagagggggatgctttctgagagtcatggatctcatgtgacaaagaaaatgaagcacctgtcggttcttcctctgcgtggtggcggctcccagtagtgggtcctgtcccagctgcagctgcgagggacgtccgggcccaggtacgtggtagaacgtcccttacgggactacccttcgtcccctacacccgttgacctacgttcgtacctcgtcgggtacgcctaccgatccgacncgacgtacgttaacgttacctttaccgttcggtcggggtccttagggaccgtcccggaccccgaaccgggacccccgggaaagggggtaaccggggtcgttacggggacggttacgggtaacggttttagggtaacgtttaaacgtttacccgaacggtacgggtacgggtactacccgttaaccgtaaaccgtaaccccgtaaccccgttacccgtaaacgtaaaacggtccggaacggtaccctaaacgtacgtacgtaccgtaacgaccgtaaccgtaaccgtaagtaaccctacgttcccacgtacgacgtcgtacgacgtccgtacgtcgtaccgacccgtcgacgtaccggtacgaccgttacgtcgttacgttaacgtcggttacggacgtaccgacgggtacccagggtccctagggttaaccgtttggttaccgtttggaaccgttcggtttcgttagtaaacggttcggttcggggtaccggtaacccaagggttccgttaacgggttccgg

SEQ ID NO: 143808 - DNA, 686 bp, Homo sapiens
  misc_feature: GYAE6OF01CF3ZV.43.71.G05.1.454.CMB.1.raw
  modified_base (680)..(686): a, c, t, g, unknown or other
  misc_feature (680)..(686): n is a, c, g, or t
tcagtgtgagtagtcacgaccggtgctcgatttagtgtcgtcgcaagagagagggggagagggaaccatggaaaccccagcgcagcttctcttcctcctgctactctggctcccagggaaagagccaccttctcctgcaggtccagtcagagtcttaccaacgactacttagcctggtaccatcagaaacctggccaggctcccaggctcctcatctacggtgcatccagcgacgggccacgtggcactcccgagacgtaggttcagtggcagtggtctgggacagacttcactctacaccgtcacgcaagacgtacggtaccctaggtaacgtatttttcgacgtaggttacgttaagtttacgtcggtactaggtacgtaaggttacgtaggggttacgtccgtaccgtaaccgtactacccgtacccggtttaccggaaccggtaacgggaacctaacgggtaaccgtagggtaaccggttaacgttaaaacccggtaacgttgggtaccggtacgtaccggacctaaccgtcttccgttacgtttccgtttacgtactttccccgttacccgtacctaacgttccgtaacgttacccttaacctacccgacgtacggttacggaacggtccgggtaccgtcgggtaaccggtaaccggctaccgagttacgcgtannnnnnn

SEQ ID NO: 143809 - DNA, 604 bp, Homo sapiens
  misc_feature: GYAE6OF01A4RZ8.43.71.G05.1.454.CMB.1.raw
  modified_base (394)..(394): a, c, t, g, unknown or other
  misc_feature (394)..(394): n is a, c, g, or t
  modified_base (589)..(589): a, c, t, g, unknown or other
  misc_feature (589)..(589): n is a, c, g, or t
  modified_base (604)..(604): a, c, t, g, unknown or other
  misc_feature (604)..(604): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaggggaaagagccaccttctcctgcaggtccagtcagagtcttaccaacgactacttagcctggtaccatcagaacctgccaggctcccgaggctcctcatctacggtgcatccagccgagggccactggcactcccgagactaggttcaggtggcgaggtgggtcgtgggacgagtacttcgactcctcaccgtcacgacgagtaccgtcggaccctggtaaagtattttcgacgtagttagtactttaacgtgtacgagtctaaggttagtggtacnctacgaccgtatccgtaccgttcggacgaacggacacgacgtaggaacgtaacgtaaccgtagtcgtacggtcgtacgaccgtacctagttccgtcgttcctcgtacgtcccttccgactacttcgtacgtaaaccttcgtaacaccgtacgtggtacggccggtagacggtacgacgtacgaccgtattacggntagctgacagtcagn

SEQ ID NO: 143810 - DNA, 813 bp, Homo sapiens
  misc_feature: GYAE6OF01ERMMK.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctccagatgggtcctgtcccagctgcagctgcaggagtcgggcccaggactggtgaagccttcggagaccctgtccctcacctgcacttgtctctggtggctccatcagcagctagtacttacttcgtggggctggactccgccacgccccgaggggacgggcgtggaggtggagttcgggaagttatttaccgacgtaggtacgggacgccgtaacctacgtaaccgaaacccgtcccctaacgaaaaacgttcggaacggacctaacctaaacgtaacgttacccggtaaacggaacccgtaaccggttaacccaaaacggtaaaaccccttaaacgtttacccgttacccccttaaagggtaaacggtaccgttacgggaaccggttaccctttaccgttacgggttaccggaacccccgggtaccccggccgaaacgggtaacccctaaccggggttcctttacggttaacccgtttaaacgtttacccggtttaggttaccgggtacccggtaacccggggaccccccggtaagggcccggtaccggtaacgggtttccgggttttacgttttttacggaacggttttccggttacccgtttttacggtaagttttaaacgggtcggggttacgggggtaaacccggaaacgggggtaacctaaacggttaccgggg

SEQ ID NO: 143811 - DNA, 603 bp, Homo sapiens
  misc_feature: GYAE6OF01AZAL3.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccaggactgggtagaacgccttcggacgacccctgtcccctcacctgcactgtctcgtggtcgcctccatcagcagcagtacttacttcgtgggctggactcccgccacgccccgaggggacggcgtggagtggtagttgggagttacgttaccagtaggtgggacgactacctactaccaacccgtccctacgaaacgtcgacgccaccatactaccgtagacacgtaccaaagaacctattcctaccctagaactctagactcctcgtgtaccgacccgtccgacaacggaccaccggtctgtaccttagttacgtgtcgaccggacggcccccgaggccgtcgtacggtcggttcgttttgacttcgttccgttttagagttaggttacgggtacgggaccgaaagggtaccgtaaggttccgg

SEQ ID NO: 143812 - DNA, 737 bp, Homo sapiens
  misc_feature: GYAE6OF01BZS03.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtccgggcccaggactggtgaacgtccgttcggacgaccctcgtccctcacctgcactgtctcgtggtgctcatcagcacgtctagttaccttacgttcgtgggtcgtggactccgaccgaccggccccggaggggacgggcgtaggaggtggtagttgggtagttacgtttaccgacgtaggtcgggacgacctaccgtaacctaaccgaaccccgtaccgtaaccgaaaaggtaccggacggtacctaacctactaccgtaccggtaacaccgtaaccgtaccgtaaacaaccgttaacttcccgtaccgtaggaacgtccgtacggtaacgtccgttacgtacggtaccggacccgccggtaaccgacggtaacccgtcgggtaccgtttacgggttacctttaacggttacgttacgggttaccgggaccggaacccgggtccccgtacggtcccggttacgtacgggtttcggtttacgtttttcggtaacgttcggtttccgtttaaggtacgttcggttaggggtacgggaaccggtaaggggtaaccgtaggttcccggg

SEQ ID NO: 143813 - DNA, 754 bp, Homo sapiens
  misc_feature: GYAE6OF01CIK6D.43.71.G05.1.454.CMB.1.raw
  modified_base (221)..(221): a, c, t, g, unknown or other
  misc_feature (221)..(221): n is a, c, g, or t
  modified_base (740)..(740): a, c, t, g, unknown or other
  misc_feature (740)..(740): n is a, c, g, or t
  modified_base (747)..(748): a, c, t, g, unknown or other
  misc_feature (747)..(748): n is a, c, g, or t
  modified_base (750)..(750): a, c, t, g, unknown or other
  misc_feature (750)..(750): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaagggaaagagccaccttctcctgcaggtccagtcagagtcttaaccaacgactacttagcctaggtaccatcagaaacctggaccaggcctcccgaggcctcctnatccgtacggtgcactccagcgacgggccacgtggacactacccagacgtaggttcaggtcggacgaggtcgggtcgtcgggaacacggtacctttcaccttcctaccgaccgtcgacggccgaacgtaccgtaccggtaacccgttaggtaaacgtttacgttttacggaccgttaggttagtttaaccgtttacgtcgggttacgaacggtaccgtaagggtttaacggtacgggttaacgtaccgttaccccggtaaacgtaccttaacccggttacccggttaaccgggaaaccgggtaaacgggacccgtaaccggtaacggtaacgggtaacgttaaaccgttaacccggtaagtcgggtacggtaccgtacgaccgtaacctacgttccgtacgtttaccttaccgtaccttccccgttacccgtacctaacgttccgtaaccgttaacctacctaacctaccgtacgtacggacggtccggtacggtagaccggacggtacgacgtgactncgtatcnngntgcg

SEQ ID NO: 143814 - DNA, 672 bp, Homo sapiens
  misc_feature: GYAE6OF01DY13A.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgcgtggtggcggctcccagatgggtcctgtcccagctgcagctgcaggagtcgggcccaggactggtgaagtccgttcggacgaccctgtccctcacctgcactgtctcgtggtcgcctacatcgagcagctacgttacttacgttcggtggggtgactccgccaccggccccgaaggggacgggcgtggaggtaggtagttgggattactttaaccgagtaggtggaacgcctaacctaaccgtacctaaccccgtaccgtaacaaaacggtcgaacggaccaccgtaatactaccggtaacgacctaaccgttacccaaaagtaaccctaacgtttaccctacccgtaagtaaacgccgttagacgtacttcgtagtaccgacccgccgtaacacgaaccgcgtacgtacgttacttaattcgtcgtacggtaccggacccggtccccgaagtcccgcgttaaggttcggtttcttttagaccttcggttaccgttgtaacttggtacggtacgggacctaaaaggggacctaaggttccggtaacccg

SEQ ID NO: 143815 - DNA, 737 bp, Homo sapiens
  misc_feature: GYAE6OF01EKQ9I.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactgggtgaacgtccgttcggacgacccttcgtcccctcacctgccactcgtctctgggtcgctcatcagcagctagtactttacgttcgtggggctggactcccgaccgaccggacccccggagggggaacggggtcgtacgggaggttagggagttagggtagttaacgtttacccgacgtaggtacgggacgaccaaccttaaccgtaacccgaaaccccgtccctaacgaaaacggttccgaacgggtacccaaccgtaacgtaaccgttacccggtaagaaaccctaaccggttaaccccgaaaacgtaaaccctaaaccgttttaccctaccccgtaacgtaacgtaccgtacggacgtccgttacgttacggttaccgaccccggaccgcgtaacggtaccgaccggtcttacggttaccttagtttaccgtcggttacggcccggacgggaccccggacgaccggtacgtaggttcgttcgtttttgacgttcgttaccgtttgagttacggtcgggtacgggtaaccggaagggtaccaaggtcccgg

SEQ ID NO: 143816 - DNA, 613 bp, Homo sapiens
  misc_feature: GYAE6OF01CYBDL.43.71.G05.1.454.CMB.1.raw
  modified_base (124)..(124): a, c, t, g, unknown or other
  misc_feature (124)..(124): n is a, c, g, or t
  modified_base (191)..(191): a, c, t, g, unknown or other
  misc_feature (191)..(191): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (368)..(368): a, c, t, g, unknown or other
  misc_feature (368)..(368): n is a, c, g, or t
  modified_base (547)..(547): a, c, t, g, unknown or other
  misc_feature (547)..(547): n is a, c, g, or t
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
  modified_base (612)..(613): a, c, t, g, unknown or other
  misc_feature (612)..(613): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaggggaaancgccaccttctcctgcaggtccagtcagacgtcttaccaagcttactagcctggtacatcagaaacntggccaggctccagctccncntcgtacgtgcatccagcaggccactggcactccaganaggttcagtaggcaggtggtcgtggacagacttcactctcaccgtcacgctacgactcggacctagaacgtattttcgctagttgttactacgtcgtctacgacgagttagtacggtanccgtacgaccgtaactcgtacccgttacggacccggtaaagggtccaacggtaacctgggtaactaacgttaaaccccgtaagttcggtagaccggttacgacctaacctacgttcttaccggtttcttacgtacttacccgttcccgtactacttacgtaccgtaattaccgtacganaccgttcgacgggtcggaccgttcgggaacgtacggtcgaaccttaggaaccgtncgatcgantnn

SEQ ID NO: 143817 - DNA, 721 bp, Homo sapiens
  misc_feature: GYAE6OF01DD53P.43.71.G05.1.454.CMB.1.raw
  modified_base (565)..(565): a, c, t, g, unknown or other
  misc_feature (565)..(565): n is a, c, g, or t
  modified_base (710)..(710): a, c, t, g, unknown or other
  misc_feature (710)..(710): n is a, c, g, or t
  modified_base (715)..(715): a, c, t, g, unknown or other
  misc_feature (715)..(715): n is a, c, g, or t
  modified_base (717)..(721): a, c, t, g, unknown or other
  misc_feature (717)..(721): n is a, c, g, or t
tcagtgtgagtagtcacgaccggtgctcgatttagtgtcgtcgcaagagagagggggagaggaaccatggaaacccagcgcagcttctcttcctcctgctactctggcctaccgagggaaagcgcctaccttctcctgcaggtccagtcgagtacttacctaaccgaactacttacgtacgcgttacgacctatacgaaacgtaccgtcggaccgaccgtccctaccggacgtcctcctataccgtcgtacggtcactacgtaccgacgcgggtacccgaactcggtacgacctaccgaccggtagaccggttaggtaacggtggttacgacggttacgggttcgggtacggtacggacgtaacgtcccttacgtaacctcctaccgtacgactacgacgtacgacgtaccggacgtaagtagtttacttagagtttatacgtttactgtcacgtagagttagtcgtaacgtcgtacgtaccgttacaccttaccgtacccggttcggaaaccgggtacgtacggacgtaacggtacgttaaaccgttaacgtaacggttaccgngggttactacaccgtacctacgttcttacgttaccgttctttactaccctttaccttacgtactaccttacgtaaccttacctactaccgtacgtagtaccggtcggtacggtaccggtcgtaaacggcgtacgaggactcggangtacngnnnnn

SEQ ID NO: 143818 - DNA, 644 bp, Homo sapiens
  misc_feature: GYAE6OF01ES6D6.43.71.G05.1.454.CMB.1.raw
  modified_base (353)..(353): a, c, t, g, unknown or other
  misc_feature (353)..(353): n is a, c, g, or t
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaacgtccgttcggacgaccccttgtcccctcacctgcctactgtcctcgtggtgcctccgatcagcagctagttacctttacttcgtgggctggactccgccgaccggcccccgaggggaacgggcgtggaggttggagttgggattacttacgagaggtggganccgtaacctactaccgaacccgtccctaacgaaaacgtcgacgacacgtatactccgagaccacgtaccaaacgaacctaacttcctaccgtagacgtactagtacgtcctcgtagtccgacccgccgacgacgacgacgtctcgttacttacttacgtgtacggccgaccggcccgagcccgagtacggttcggtttcgttttaggacgtttccggttaccgttttaggtaactttaggttacggggtaccggggtaaccgaaacggggttaacctaagggttacccggg

SEQ ID NO: 143819 - DNA, 656 bp, Homo sapiens
  misc_feature: GYAE6OF01ADOJK.43.71.G05.1.454.CMB.1.raw
tcagtgtgagtagtcacgaccggtgctcgatttagtgtcgtcgcaagagagaggggatgctttctgagagtcatggatctcatgtgcaagaaatgaagcacctgtggttctcctcctgctggtggcgctcccagatgggtcctgtcccagctgcagctgcaggacgtccgggcccaggactggtagaacgccttcggactaccctgtccctcacctgcactgtctcgtggtcgctccatcagcagctagttacttacttcgtgggtctggactccgccacgccccgagggacggcgtggaggtggagttggattacttaccacgtagtgggactaccgtacctaacctaccgtaaccccgtacctacgaaacgtcgaacggtccaactatacgtaccgtaagacctaaccgtaccgaaacgtaacctaactttcctaccgtagtaaacgtcgtagaccgtcgtcgtacggtaccgacccggaccgaccgtacgaaccgtaccggtcttacgttaccgttacgttaaccgtcggtaccggaccgaccggccccgtacggaccgtcgtacggttcgttccgtttttaggaccgtttcggttaccgtttagacgttacgttcgggtacggggaaccctaagggtcgtaacggttcccgg

SEQ ID NO: 143820 - DNA, 685 bp, Homo sapiens
  misc_feature: GYAE6OF01B80RO.43.71.G05.1.454.CMB.1.raw
  modified_base (215)..(215): a, c, t, g, unknown or other
  misc_feature (215)..(215): n is a, c, g, or t
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
  modified_base (681)..(685): a, c, t, g, unknown or other
  misc_feature (681)..(685): n is a, c, g, or t
tcagtgtgagtagtcacgaccggtgctcgatttagtgtcgtcgcaagagagaggggggagagggaaccatggaaaccccagcgcagcttctcttcctcctgctactctggctcccgaggggaaagacgccaccttctcctgcaggtccagtcagagtcttaaccaacgactacttagcctggtacatcagaacctggccaggctccagcctcctnatcgtacggtgcactccagcgacgggaccacgtcggcactacccagacgtaggttacaggtggaccgagggttcgggtcgtagggacgtaggtacttcactcaccgtaccgtcacgcgagtacgccggaaccctgtaacgttatttcgactagttcgttattacgttgtacaggtacgtaggttaagttcgggtaacgcctaccgtaaccggtactacccggttaccggtaccgggaaccggaacgggtaacctacgggtaaccgttaagggtaaaccgtaaaccggtttaaaccgcggttaacggttcggaccttccgaactaccttaacgtccttacggtttcccttactaccctttcccgtaccccgtacttaagtccgtaacgttaaccttacctactacccgtacgtacgggtcggaccgggttcacgggtacggaacggtccgataggtacgngagnacnnnnn

SEQ ID NO: 143821 - DNA, 783 bp, Homo sapiens
  misc_feature: GYAE6OF01CDIHF.43.71.G05.1.454.CMB.1.raw
tcagtgtgagtagtcacgaccggtgctcgatttagtgtcgtcgcaagagagagggggatgctttctgagagtcatggatctcatgtgacaaagaaaatgaagcacctgtggttcttcctcctgctggtggcgctccagagtcgggtcctgtcccagctgcagctgcgaggaggtccgggcccaggtacgtggtagaacgtcccgttcgggaccgtaccccgtcgtcccctccgacctcgcctacgttcgtctcgtggtcgcctcatcagcagtctagtttacttacgttcggtggggtcgtacggacctccccggaccacccggaccccgggagggggaacggggtcgtgggaggttggtaggttcggggtaactttaccgttaaccgacggtagggtcgggacgaccctaacccgttaacccgtaacccgtaacccccgttaaccctaaacgtaaaacgggtacgaaccggacctaaccggttactaccgtaaccggtaacgaacccgtaccgtaaacccaaacgtaaccttaacttccccgtaaccgagtaaccgcgtacgtacgtccttacgtcggacccgcccgacccgtaccgacgacccgtccggtacgttcttaaccgttacgttacgtcggtaccgggccgacccgggcccgagtccggtacgttacggttcgggtttacgttttacggtagtttacccgttcgttttaagaggtttacccgggttcggggtaaccgggggtaacccgtaaagggtacccgttaaggttcccggg

SEQ ID NO: 143822 - DNA, 738 bp, Homo sapiens
  misc_feature: GYAE6OF01AYSNX.43.71.G05.1.454.CMB.1.raw
  modified_base (231)..(231): a, c, t, g, unknown or other
  misc_feature (231)..(231): n is a, c, g, or t
  modified_base (724)..(724): a, c, t, g, unknown or other
  misc_feature (724)..(724): n is a, c, g, or t
  modified_base (730)..(730): a, c, t, g, unknown or other
  misc_feature (730)..(730): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaggggaaagagccaccttctcctgcaggtccagtcagagtcttaccaacgactacttagcctggtaccatcaacgtaaacctggccaggcctcccgagcctcctcatcgtacggtnacatccagcacgggccactggaccactccccaaggacgtaggttcaggtcgggcgtaggttggggtaccgtggggactaacgtaccttaccgtacctacgttacccgaacccggttcgaacggccaacgggtacccgtacgggtacccgttaggtaaacgtttcgttttacgacgtacgtttaggttaactttacgtcggtaactacggtactaagggttacttacggggtaacgaccttacccggaaccgttacttacccgtacccggttacggaacccggtaaccggtacgtaaccggtacggtacggtaacggtaaccttaaccggtaaccgttacgggtacggtacgtacgaccgtaacctacgttcgttacgtttaccttacgtccttaccccgtcccgtaccgtacttaccgtaactacccgtactaccgtaaccgtactacgggcgtaccgggtcgttacggacgaccggtgtaacgtagcgtacngtccangcngngta

SEQ ID NO: 143823 - DNA, 560 bp, Homo sapiens
  misc_feature: GYAE6OF01A10M2.43.71.G05.1.454.CMB.1.raw
  modified_base (325)..(325): a, c, t, g, unknown or other
  misc_feature (325)..(325): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (400)..(400): a, c, t, g, unknown or other
  misc_feature (400)..(400): n is a, c, g, or t
  modified_base (502)..(502): a, c, t, g, unknown or other
  misc_feature (502)..(502): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(557): a, c, t, g, unknown or other
  misc_feature (556)..(557): n is a, c, g, or t
  modified_base (560)..(560): a, c, t, g, unknown or other
  misc_feature (560)..(560): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccacgtggcatcccagacaggttcagtggcagtgggtctgggacagtacttcactctcaccgtcgagcagacgtcggaccctgaacgtnttttgctagttagtattacgtgtcagctagtntcggtancgtcacgactcgtaccgttcggcaacgggacacggngtacggacgtaacttaaccgaactggtacggtctcgacacctatctcgttcttactacttcccgttcccgacctactccgtacgtaaacctaccttacaacncgttcggacggtcgggtcgtacgggacacgggtccagtactagngtcagnancnncgn

SEQ ID NO: 143824 - DNA, 765 bp, Homo sapiens
  misc_feature: GYAE6OF01BTBKF.43.71.G05.1.454.CMB.1.raw
  modified_base (561)..(561): a, c, t, g, unknown or other
  misc_feature (561)..(561): n is a, c, g, or t
tcagtgtgagtagtcacgaccggtgctcgatttagtgtcgtcgcaagagagagggggatgctttctgagagtcatggatctcatgtgcaagaaatgaagcacctgtgttcttcctcctgctggtggcgctccagatgggtcctgtcccagctgcagctgcagggacgtccgggcccaggactggtcgaacgtccgttacggacgtacccttcgtcccctacaccttgcctactcgttctcgtggtcgcctcatcgagcagtctagttaccttacgtcgtggggtctggacctcccggccgaccggtacccccggaagggggtacgggtcgtagggtacggttacgggtagtttacggggtaatttacgtttaaccgacggtagggtacgggtacgaccctaaccgttacctaacccgtaaccccgttacccgtaacgaaacggtcggaacggtaccaaccgtaactacgtaccggaacgaccgtaacgtaaccaaacgtaacctaacttcctaccgtagacgtctacggtactccgtacgtacgtaccgacccgtaccganaccgtaccggtacgttacttccgtaacgtttaccttcgtacgggtaccggaccgggtaccccgacccggacggtccgtaccggttaggttccggttttaaccgttttcggaacgtttaccggtttacggtttacggtaacgtttaccgggtacggggtttaccggggaaaccgtaaaccggggttaataccgggttaacccggg

SEQ ID NO: 143825 - DNA, 905 bp, Homo sapiens
  misc_feature: GYAE6OF01C3T7H.43.71.G05.1.454.CMB.1.raw
tcagtgtgagtagtcacgaccggtgctcgatttagtgtcgtcgcaagagagagggggatgctttctgagagtcatggatctcatgtgacaaagaaaatgaagcacctgttggtttcttcctcctgctggtggcggctcccagagtcgggtcctgtcccagctgcagctgcgaggacggtccgggacccaggtactgggtacgaacgtccgttacggaccgtcccttcgtcccctactacctgcctacgttcgtcctcggttaggtccgcctaccacgtacgacgcgagaccgtacgtttacctttacgttcggtcgggtcgtacggtacctcccggacccgacccgggacccccgggaagggggtacgggcggtagggtacggttagggtaaggtttacgggttaacgttaacgtttaaccgacggtagggtacgggtaacctaccgtaaacccttaaccgtaaaccccgtaacccccgttaacccgtaaaccggtaaaaccggtaccggaaccggtaaccctaacccgtacgtttaaccggtaacccgtaaaccgtaacccgtaaacccgtaaacccgtaaaaccgtaaacccttaaccttacccgtaaccgtaacggtaaccgtacgtaccggtacgtccgttacgtcggtacccgacccgtcggaccgaacggtacccggaccgtttacgttacttaccgtttaacgtttaccggtcgggtaaccggtcccggaaccccggggtcccgaacgggttcccggtaacggttacggtttccgggttttacttttacggggtacctttccggtttaaccggttttacggtaacgggtttaacgggttccgggggtaaaccgggttaacccgggtaaacggtaacccggttaacgggttaccccggg

SEQ ID NO: 143826 - DNA, 718 bp, Homo sapiens
  misc_feature: GYAE6OF01CZYBJ.43.71.G05.1.454.CMB.1.raw
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
tcagtgtgagtagtcacgaccggtgctcgatttagtgtcgtcgcaagagagagggggatgctttctgagagtcatggatctcatgtgacaaagaaatgaagcacctgttcgttctcctctgctggtgccgcctcccagagtcggtcctgtcccagctgcagctgcgaggcgtccggccaggactgganacgtccgtcggactccctncccgtcaccgtgacctacgttcgtcctcggttggcgacctcctagtcagcctagtcctaacgtttacctttacgttccggcgggtctacggactccccgccgtacccggacccccgggtaaggggtaggtccgtagggaggttaggtaacggtttaggtactttaaccgttaacccgaggttggacggtacacctaaccgtaccgtaacccgtacccgtaccaacgtaaaccggtcgaccgtaacctacgtattaaccgtccggtaacaacgtaccgtaaccaaacgtaccttacgtccctaccgtagaacgttcgagtaaccgtccgtgttacgacccgacccgacgacctaacgacctacgggtctttacttaacgtaaccgtttacggcgggtacccgtaccggacccgaccgtcgtaccgttggtacgtttcgttctttaggacctttccgttacgttagtcggtaggttccgggtaacggacgaacggtttacgtcgttacccggg

SEQ ID NO: 143827 - DNA, 703 bp, Homo sapiens
  misc_feature: GYAE6OF01ELGF8.43.71.G05.1.454.CMB.1.raw
  modified_base (227)..(227): a, c, t, g, unknown or other
  misc_feature (227)..(227): n is a, c, g, or t
  modified_base (694)..(694): a, c, t, g, unknown or other
  misc_feature (694)..(694): n is a, c, g, or t
  modified_base (699)..(699): a, c, t, g, unknown or other
  misc_feature (699)..(699): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaggggaaagacgccaccttctcctgcaggtccagtcagagtcttaccaacgactacttagcctggtaccatcagaaacctggccaggctcccgaggctcctcatctacggtncactccgagcgagggccctacgtcggcctactacccgaggtaccgtaggttacaggtcggacgtaggtcgggtcgtgggacgagtacttacgacgtcctaccgaccgtacgacgacgtacgaccgtacggaccgtacggtaagttagttttcggacgtaggttagtacttacgtcggtacagtacgtaagttacgttacgggtacgtacctaccgaaccgtacgtacccgtaacccggttacgggtacccggaaacgggaccgtaccgtaacggtacggaacgttaaccgttaaacccgtacggtcggtacggcgttacggacctaaccgtcttacgttcttaccgtcttaaccgttccttcccgaccttacgttaccctaacgttaaccttactacccgtaacgtacgtacgggaccgggtacgggtaccgtacgggacgtaccggacacgtggaggtcatcacgngtagntgcg

SEQ ID NO: 143828 - DNA, 858 bp, Homo sapiens
  misc_feature: GYAE6OF01E27W2.43.71.G05.1.454.CMB.1.raw
  modified_base (141)..(141): a, c, t, g, unknown or other
  misc_feature (141)..(141): n is a, c, g, or t
  modified_base (333)..(333): a, c, t, g, unknown or other
  misc_feature (333)..(333): n is a, c, g, or t
tcagtgtgagtagtcacgaccggtgctcgatttagtgtcgtcgcaagagagagggggatgcttttctgagagtcatggatctcatgtgacaaagaaaatgaagcacctgtggttcttcctctgctgggtggcggctccagngtcgggtcctcgtcccagctgcagctgcgagggacgtccgggccaggactggtacgaacggtccttcgggactccctcgtccctcacctgcctacgttcgtccttcggtggcggtacctacctaagtccacggactacgtaccgttaacgtttaaccgtttccgttcgggtacggggtcctacgggtacccnccccggaccacccggggaccccgggaagggggtcggtcgtagggtacggttagggtaaggtttacgggtaactttacgttaccgacggtacggtacgggactacctaacccgttaacctaaccccgtaaaccccgttaccgaaacggtaaaacggtcggaactaccaaccgttataaaccggttaccggaactaaaccggacccttaaccgaaaacgtaacccttaacgttccccggactaagggacgtctacggtacgtaccttcggacggtaacccgcccgaccggtaagaccgaccgttcggtaccgtttgttaaaccggttaactttcccgggttggacccggtacccgggtacccgggaccccgtaaggggttcccgtaccgggttaggtttacccgggtttcctttttagggtaccgtttaccggtttacgtttaacgggtaaggtttcccggggtaaacgggggttaacccggggaaaacccgggttaacggtttaaaccgcccgggttttaacccgg

SEQ ID NO: 143829 - DNA, 800 bp, Homo sapiens
  misc_feature: GYAE6OF01BBL7F.43.71.G05.1.454.CMB.1.raw
  modified_base (115)..(115): a, c, t, g, unknown or other
  misc_feature (115)..(115): n is a, c, g, or t
tcagtgtgagtagtcacgaccggtgctcgatttagtgtcgtcgcaagagagagggggatgctttctgagagtcatggatctcatgtgacaaagaaatgaagcacctgtgttctcnctgcgtggtgcgctccagagtcgggtcctcgtcccagctgcagccgtgcgagggacggtccgggcccagggtactgggtcgtaaccggtccgttacgggaaccgtacccgttcgttaccccctactaccgtgaccctacgttcgttccttccggtcggtacgcctcaagtcgagacacgtacgtaccgttacctttacggttccggtaaggggtcgttacggacccgtcccggaaccccggtaccccgggtaacccggggaagggggtaacgggtccggtagggtacgggttagggtacggtttaggggtaaacctttaccgttaacccgagggttacgggtacgaaccggtaccctaaccgttaaccgtaaacccccgtaaccccgttaacgtaaacggaacggtaaccggaacgtaaccctaccgtaaagtaccgttaccggaaacgtaaccgtacccgtaaccgaaaaccgttcctaaccgttccgtaccgtaacgaggtcctacggctacgtccgtacggtacccgtaccggcctacgaacgttcgacgttctacgttcttacgtgtccggacgtcgacccgggtaccaggtccgtacggtacgtttcgtttagtcgtacgttacgtggtttagaacggtttacggtacgggaccggtaacggagttaacgtgtaccccgg

SEQ ID NO: 143830 - DNA, 681 bp, Homo sapiens
  misc_feature: GYAE6OF01A5FB5.43.71.G05.1.454.CMB.1.raw
  modified_base (323)..(323): a, c, t, g, unknown or other
  misc_feature (323)..(323): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaggggaaagagccaccttctcctgcaggtccagtcagagtcttaccaacgactacttagcctggtaccatcaagaaacctggccaggcctcccgaggcctacctcactcgtacggtgcactccagcgacgggccacgtggcactcccagaacgtagggttcaggtcggacgtagggtgggtacgtagggacacgtaccttcacctccncctaccggtcagtacagaccgtacggacccttaggtaacttacgtttggacctaggtttagttaacgttaccgttagtaccaggtacgtaggttaggtaggtacgtcctaccgaaccgtacgtacccgtaccggttacgggaccgaacgggaccgacggtagtaacggtagtaaccgttaaccgtacgttcgggacgactacgacctaccgtagttccttcgttaccgttctaccgttcccgttccctacgtaactccttaaccgtaactccttaccaacgtaccgtcggtacgggcccggtacgacggaacggacggtacgaaccggtaagtcgagtacgtacgtcgacncngngtn

SEQ ID NO: 143831 - DNA, 930 bp, Homo sapiens
  misc_feature: GYAE6OF01ANKUO.43.71.G05.1.454.CMB.1.raw
  modified_base (124)..(124): a, c, t, g, unknown or other
  misc_feature (124)..(124): n is a, c, g, or t
  modified_base (925)..(925): a, c, t, g, unknown or other
  misc_feature (925)..(925): n is a, c, g, or t
  modified_base (928)..(928): a, c, t, g, unknown or other
  misc_feature (928)..(928): n is a, c, g, or t
  modified_base (930)..(930): a, c, t, g, unknown or other
  misc_feature (930)..(930): n is a, c, g, or t
tcagtgtgagtagtcacgaccggtgctcgatttagtgtcgtcgcaagagagagggggagagggaaccatcggaaaccccagcgcagcttctcttcctcctgctactctggcctccgaagggaanagcctaccttctcctgcacggtccagtcgagtagttccttaaccaacgtacttacttacgccgttacggtaaccctataccgaacgtaaacccgtcgggacccagggtccctacccgacggtcccttccctactaacgttccgttacgggtctacctaccgtccgaaggccgtaacggggcccaacggttcgggacctaaccgtacccgaagtacggtaaccggtttcgaagggtacggtacggtacggggttacggggtaccggtcgggtaaccgtaccgttaaccgtttaccaaacccgtttccgttaaccccgggtaacccgttaccggaacggtacccgtaaccgggttaacccgtaccccggggtttaaacccggtaaaggtttaaccggttttacgtttacgggtacccgttaaggtttaccgtttaaacgtttccggtacggttaacgtacgggttaaacggttaggttaaccggtttacgggtttaacccggttaccttaaccggtacccttacccggtaaccccgggtttaccgggaaaccgggtaacgggtaacccgtacggttaaccgggtaacggttaacgtaacccggtttaacggaaccgggtttcgaccggtaccgtaccgtaaccgttaccgtacgtttccgtaccgttaccttccgtacttcccgtacccgtccttacgtacgtaaccctaacgttacctaccgttaccggacgtacggaccggtacgggtaccgtaccggtacgttaaaccggcgttacgtacgacgtgtcacgtactacgcnctngn

SEQ ID NO: 143832 - DNA, 696 bp, Homo sapiens
  misc_feature: GYAE6OF01BZJ44.43.71.G05.1.454.CMB.1.raw
  modified_base (682)..(682): a, c, t, g, unknown or other
  misc_feature (682)..(682): n is a, c, g, or t
  modified_base (693)..(694): a, c, t, g, unknown or other
  misc_feature (693)..(694): n is a, c, g, or t
  modified_base (696)..(696): a, c, t, g, unknown or other
  misc_feature (696)..(696): n is a, c, g, or t
tcagtgtgagtagtcacgaccggtgctcgatttagtgtcgtcgcaagagagaggggggagagggaaccatggaaaccccagcgcagcttctcttcctcctgctactctggctcccgaggggaaagagccaccttctcctgcaggtccagtcagagtcttaccaacgactacttagcctggtaccatcagaaacctggccaggcctcccaggctcctcatctacggtgcatccagcgacgggccacgtggcactcccaagactaggttcaggtcggcgtaggtgggtcgcggggaacacggtaccttcacctcctccgaccgtcacgcacgacgtacggaccctaggtaacgttagttttgacctaggttacgttaacttacgtcgtacgagtcgtaagttagtggtacgcctaccgaccgtactaccgtaccgtaccggaccgtaacgggacctacggacgtagggtaacgtaacgttaaacccgtagttcggtcggtacctacgtaccctaacctaacgttcccttacggttacccttaccgttaccgttccccgttaccccgacccttaacgttacccgtaacccgttaaccttaacccgtacgtaacccgtacgttaacgggaccgggccgggtacgtacccgggtaacggaccgggtacgtaaccggtaataacggtntcgtgacagcnngn

SEQ ID NO: 143833 - DNA, 633 bp, Homo sapiens
  misc_feature: GYAE6OF01AR70R.43.71.G05.1.454.CMB.1.raw
  modified_base (508)..(508): a, c, t, g, unknown or other
  misc_feature (508)..(508): n is a, c, g, or t
  modified_base (583)..(583): a, c, t, g, unknown or other
  misc_feature (583)..(583): n is a, c, g, or t
  modified_base (623)..(623): a, c, t, g, unknown or other
  misc_feature (623)..(623): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctctgctggtggcggctccagatgggtcctgtcccagctgcagctgcaggagtcgggcccaggctggtagaacgtccttcggacacccttgtcccctcacctgcctactgtcctcgtggtcgctaccatcagcagctagtacttacttcgtggggctcgactccggccaccggaccccggaggggacgggcgtagggaggtggtagttagggtacgttacgtttaccgagtaggtagggacacctacctaacctaaccgaaccccgttaccctaacgaaacgtccggaacgaccaaccactacgtaccgtacaaccgtaccgtaacctaaacgaaccctaacgttcctaccctagaacgacgttgacgtctcgtagtccgacccgccacgtanaccgacggtctcgttattaccgttagtcggtacgacggcccggccgagtacgtcgtacggttggttacgtttcgngttcgtcttagtacgtgttcgggacggtaaccgaacggtntacggttacg

SEQ ID NO: 143834 - DNA, 479 bp, Homo sapiens
  misc_feature: GYAE6OF02HBGBY.43.71.G05.1.454.CMB.1.raw
  modified_base (472)..(479): a, c, t, g, unknown or other
  misc_feature (472)..(479): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccgccatctgaactactcacactgagcggctggcaaggcgcatagnnnnnnnn

SEQ ID NO: 143835 - DNA, 475 bp, Homo sapiens
  misc_feature: GYAE6OF02FWKQN.43.71.G05.1.454.CMB.1.raw
  modified_base (464)..(464): a, c, t, g, unknown or other
  misc_feature (464)..(464): n is a, c, g, or t
  modified_base (470)..(475): a, c, t, g, unknown or other
  misc_feature (470)..(475): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgactgtggctgcaccatctgtcttcatcttcccgcatctgaactctcacactgagcggctggcaaggcncatagnnnnnn

SEQ ID NO: 143836 - DNA, 480 bp, Homo sapiens
  misc_feature: GYAE6OF02F94MC.43.71.G05.1.454.CMB.1.raw
  modified_base (419)..(419): a, c, t, g, unknown or other
  misc_feature (419)..(419): n is a, c, g, or t
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
  modified_base (474)..(480): a, c, t, g, unknown or other
  misc_feature (474)..(480): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaacctgaagattttgcagtgtattactgtcagcagtatggtagctcaccgatcaccttcggccaagggacacgactggagattaaccgaactgtgctgcacatctgtcttnatcttcccgcatctgaactactcacnctgagcggctggcgaaggcgacatagncnnnnnnn

SEQ ID NO: 143837 - DNA, 482 bp, Homo sapiens
  misc_feature: GYAE6OF02GAT4Q.43.71.G05.1.454.CMB.1.raw
  modified_base (474)..(475): a, c, t, g, unknown or other
  misc_feature (474)..(475): n is a, c, g, or t
  modified_base (477)..(482): a, c, t, g, unknown or other
  misc_feature (477)..(482): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaacctgaagattttgcagtgtattactgtcagcagtatggtagctcaccgatcaccttcggccaagggacacgactggagattaaccgaactgtggctgcaccatctgtcttcatcttcccgccatctgaactactcacactgacgcggctggcaaggcgcatagnncnnnnnn

SEQ ID NO: 143838 - DNA, 478 bp, Homo sapiens
  misc_feature: GYAE6OF02GMTZ8.43.71.G05.1.454.CMB.1.raw
  modified_base (471)..(478): a, c, t, g, unknown or other
  misc_feature (471)..(478): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccgcatctgactactcacactgagcggctggacaaggcgcatagnnnnnnnn

SEQ ID NO: 143839 - DNA, 479 bp, Homo sapiens
  misc_feature: GYAE6OF02GZCCX.43.71.G05.1.454.CMB.1.raw
  modified_base (387)..(387): a, c, t, g, unknown or other
  misc_feature (387)..(387): n is a, c, g, or t
  modified_base (472)..(479): a, c, t, g, unknown or other
  misc_feature (472)..(479): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagtattttgcagtgtattactgtcagcagtatggtagctcacgatcaccttcggccaagggcacgactgganataacgactgtgctgcaccatctgtcttcatccttcccgctatctagacctactcacactgagcggctggcgaaggcgcagtagnnnnnnnn

SEQ ID NO: 143840 - DNA, 614 bp, Homo sapiens
  misc_feature: GYAE6OF02H6GN7.43.71.G05.1.454.CMB.1.raw
  modified_base (280)..(280): a, c, t, g, unknown or other
  misc_feature (280)..(280): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
  modified_base (611)..(613): a, c, t, g, unknown or other
  misc_feature (611)..(613): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacngacttcactctcaccgtcagcagactggaccctgaagtattttgctagtgtattactgtcagctagtagtggtagtctcaccgtatacctaccgttccgggaccgtaaacgggacgaacggtaccgttagggaacgtaacgttaaacccggaacgttggtacggtcttacggaccaccgtactacgttcgttccttacctacttcccgttcccgtacctacttaccgtacgtaaaccttacctacctaacctaccgttacggaaccggtcgggtaccgttacgggaaccggtaacgggtccgtaccgtaacgttaacggngacgcgtnagnnnc

SEQ ID NO: 143841 - DNA, 475 bp, Homo sapiens
  misc_feature: GYAE6OF02GPQXZ.43.71.G05.1.454.CMB.1.raw
  modified_base (468)..(468): a, c, t, g, unknown or other
  misc_feature (468)..(468): n is a, c, g, or t
  modified_base (470)..(475): a, c, t, g, unknown or other
  misc_feature (470)..(475): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcacgatcaccttcggccaagggcacgactggagataaccgaactgtgctgcacatctgtcttcactcttcccgcatctgaactactcacactgagcggctggcgaaggcgcatgncnnnnnn

SEQ ID NO: 143842 - DNA, 483 bp, Homo sapiens
  misc_feature: GYAE6OF02FJKHK.43.71.G05.1.454.CMB.1.raw
  modified_base (469)..(469): a, c, t, g, unknown or other
  misc_feature (469)..(469): n is a, c, g, or t
  modified_base (475)..(483): a, c, t, g, unknown or other
  misc_feature (475)..(483): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatccccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactacttcacactgagcggctggcaaggcncatagnnnnnnnnn

SEQ ID NO: 143843 - DNA, 526 bp, Homo sapiens
  misc_feature: GYAE6OF02G2HQQ.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccagcccccagggaaggggctggagtggattgggagtatttaccacagtgggagcacctactacaacccgtcctacaaaagtcgaggcacatatccgtagacacgtaccaagaaccaattcctaccctgaacgctagacgtctcgtgtcgaccgccgcacgacacggctgtctattactgtgcgacggcccgagccgcacgtcggtcttttgattcgtcctttgattagtcggtcgggtaccgaagggtacaagtcgg

SEQ ID NO: 143844 - DNA, 485 bp, Homo sapiens
  misc_feature: GYAE6OF02G5J3N.43.71.G05.1.454.CMB.1.raw
  modified_base (476)..(476): a, c, t, g, unknown or other
  misc_feature (476)..(476): n is a, c, g, or t
  modified_base (478)..(485): a, c, t, g, unknown or other
  misc_feature (478)..(485): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctggggacagacttcactctcaccgtcagcagactggaccctgaagattttgcagtgtattactgtcagcagtatggtagctcaccgatcaccttcggccaagggacacgactggagattaaccgaactgtggctgcacatctgtcttcatcttcccgctatctgaactctcacactgagcgggctggacaacggcgcagtagntnnnnnnnn

SEQ ID NO: 143845 - DNA, 517 bp, Homo sapiens
  misc_feature: GYAE6OF02F3ZYR.43.71.G05.1.454.CMB.1.raw
  modified_base (468)..(468): a, c, t, g, unknown or other
  misc_feature (468)..(468): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccagggactggtgaagccttcggagaccctgtccctcacctgcactgtctctggtggctccatcagcagcagtacttacttctggggctggatccgccagcccccaggggaaggggctggagtggattggggagtatttaccacaggtggggagcacctactaaccaacccgtccctacaaaagtcgaacggcaccaatatccgtagacacgtccaagaaccaattctaccctgaagctgagctctgtgaccgccgcacgacacggctcgtctattactgtgcgacggcccgngcgcagtggtcttttgatgtctttgatatgtgggccagggtacagtcgg

SEQ ID NO: 143846 - DNA, 565 bp, Homo sapiens
  misc_feature: GYAE6OF02JQ0AA.43.71.G05.1.454.CMB.1.raw
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (561)..(565): a, c, t, g, unknown or other
  misc_feature (561)..(565): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatccccagacaggttcagtggcagtgggtctgggacagacgttcactctcaccgtcacgcagactggaccctgaagtattttgcagttgtattactgtcagcagtagtggtagctacaccgtatcctaccgttcggccgtaagggacaacgacgtgggaagtaacttaaacccgaacgtggtcggctacgccaaccgattcgttcgtcctttctacttccgttcccgtcctactccgtactaaccgttacctccgtaaccactcgtacgggccgggtcgtaggaccgaacgggacctacgagttacgngtcnctcgnnnnn

SEQ ID NO: 143847 - DNA, 628 bp, Homo sapiens
  misc_feature: GYAE6OF02JXDFE.43.71.G05.1.454.CMB.1.raw
  modified_base (624)..(624): a, c, t, g, unknown or other
  misc_feature (624)..(624): n is a, c, g, or t
tcagtgtgagtagtcacgaccggtgctcgatttagtgtcgtcgcaagagagagggggagagggaaccgatggaaacccagcgcagcttctcttcctcctgctactctggctcccaggggaagagccaccttctcctgccaggtcccagtcagagtcttaccaacgacctacttagcctggtaccatcagaaacctggccaggctcccaggctcctcatctacggtgcatcccagccagggcccactgggccattccccgagactacggtcacgtggcgagtgggtctcgggacaggacttcacgtctcaccgtcacgcagactcggaccctggtaagacgttttgactacgtgtattacgtgtcaggacagttactggtagtcgtacaccgacttctaccgttccggccgaacgggtacgaccgtacggtacggtagtaacgttaaccgaacgtcgtaggtcgttcggactacgtactccgttcgtaccttctacgtcccttccgtaccctacgttacccttacgtaaccgttaccttaccgtaacctacgtacggtaccgacgggtccgtacggtaccgtaacgggccgtacctagttaacgtcgacgttcgagtacgcgtancgtg

SEQ ID NO: 143848 - DNA, 510 bp, Homo sapiens
  misc_feature: GYAE6OF02ID8JQ.43.71.G05.1.454.CMB.1.raw
  modified_base (347)..(347): a, c, t, g, unknown or other
  misc_feature (347)..(347): n is a, c, g, or t
  modified_base (464)..(464): a, c, t, g, unknown or other
  misc_feature (464)..(464): n is a, c, g, or t
  modified_base (486)..(486): a, c, t, g, unknown or other
  misc_feature (486)..(486): n is a, c, g, or t
tcagtgtgagtagtcacgaccggtgctcgatttagtgtcgtcgcaagagagaggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattggggagttatttaccacgagtgggagcactactaccaaccgtcccanaaaacgtcgagcaccaatatccgtagacacgtaccaagaaccaaattctccctgaaagctgagctctgttcgaccgccgcagacacggctgtctattactgtgcgcgcccgagcgcngtggtcttttgatcgcctttgntagtggtgggccaaggtcagtcgg

SEQ ID NO: 143849 - DNA, 722 bp, Homo sapiens
  misc_feature: GYAE6OF02IK1B3.43.71.G05.1.454.CMB.1.raw
tcagtgtgagtagtcacgaccggtgctcgatttagtgtcgtcgcaagagagagggggagagggaaccatggaacccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcactccagcgacgggcccagtcggcactcccagacctaggttcaggttcggacgaggtcgggtcgtgggacgaggacttcactctcctaccgcagctagacctcggacctagaagtattttacgaccgtaagttggttaacttacgttacgtcggtagtaccgtaagttaggttacgggtacgtaccgttaccgaacccggtaactccttacccggttacccggggtaccggtaaacgggaacctaccggacgttacgggaagttaaccggttaaaccggtaacgttaggttcgggtcgtacggccaaccgtacgttacctttcggtacctttactaaccgtttccgttaaccccgtccgtacccttacgttaccggaaaccttaccgttacctaaccgtaaacccgtgggtaacccggtccggggttaccgtacggggtaccgtaaaccgggggtccgtaacgttaacgtacggtaacgcgacgtacgctagtcgtgcg

SEQ ID NO: 143850 - DNA, 699 bp, Homo sapiens
  misc_feature: GYAE6OF02HTI6G.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcagggagtcgggcccaggactggtgaacgccttcggacgaccctgtccctcacctgcactgtctcgtggtcgctccatcagcagcagtacttacttcgtgggctggactccgccacgccccgaggggacgggcgtgggaggtggtagttgggagttacgtttaaccgacgtaggtaggggacgacctaaccgttaacctaacccgaacccgttaccctaacgaaaacgtcggaacggaccaacctaatacgtaccgtaacgaccgaaccgtaccaaacgaaaccctaaactttaccggggggggtaccctacggaacgtacgtacgtacgtacctcgtacggtacgtacccggacccgaccgaacgaaccgaccggtccgttcggttaccgttacgttaccgttacggtacggtaccggaccgggaccccggaccgccgtacgtacggttcggttcgttttcggtacgttcggttccgttttacgtagttacggttcgggtacggggtaccggtaacgggtacgtaaggttacgg

SEQ ID NO: 143851 - DNA, 490 bp, Homo sapiens
  misc_feature: GYAE6OF02GMKXF.43.71.G05.1.454.CMB.1.raw
  modified_base (474)..(474): a, c, t, g, unknown or other
  misc_feature (474)..(474): n is a, c, g, or t
  modified_base (481)..(483): a, c, t, g, unknown or other
  misc_feature (481)..(483): n is a, c, g, or t
  modified_base (485)..(490): a, c, t, g, unknown or other
  misc_feature (485)..(490): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaacgattttgcagtgtattactgtcagcagtatggtagctcaccgatcaccgttcgaccaagggacacgacgtggaagacttaacgaactgtggctgcactatctgtcttcactctcccgcatctcgactactcacactgacgcggtctggacgaaggcncgatagnnngnnnnnn

SEQ ID NO: 143852 - DNA, 520 bp, Homo sapiens
  misc_feature: GYAE6OF02IJCUC.43.71.G05.1.454.CMB.1.raw
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (450)..(450): a, c, t, g, unknown or other
  misc_feature (450)..(450): n is a, c, g, or t
  modified_base (468)..(468): a, c, t, g, unknown or other
  misc_feature (468)..(468): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccacgcccccgaggggaacggggctcgggagtggattgggagttatttaccacaggtggagcacctactacaacccgtcctacaaagtcgagcacatactcgtagacacgtccaagaacctaattcnccctgaagctgacnctctgtcgaccgcccgcacgacgacggctgtctattacnggtgcgacggcccaggcncagtgtcttttggattgtcctttgagtgtggtaggaccggaggactagtcgg

SEQ ID NO: 143853 - DNA, 524 bp, Homo sapiens
  misc_feature: GYAE6OF02FZ3PM.43.71.G05.1.454.CMB.1.raw
  modified_base (515)..(516): a, c, t, g, unknown or other
  misc_feature (515)..(516): n is a, c, g, or t
  modified_base (519)..(524): a, c, t, g, unknown or other
  misc_feature (519)..(524): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatccccagacaggttcagtggcagtgggtctgggacagacttcactctcaccgtcagcagactggaccctgaagtattttgctagtgtattactgtcagctagtatggtagctcacgatctaccgttcggaccaagggaccacggacgtaggagtaacttaaccgaactgtcggctgccaacctatccttgttccttcacttccttcccgctatctacgtaacctactcaactacgtcgacggcggtctggacgaaggccgactagtacgnngannnnnn

SEQ ID NO: 143854 - DNA, 492 bp, Homo sapiens
  misc_feature: GYAE6OF02FVWFZ.43.71.G05.1.454.CMB.1.raw
  modified_base (483)..(484): a, c, t, g, unknown or other
  misc_feature (483)..(484): n is a, c, g, or t
  modified_base (486)..(488): a, c, t, g, unknown or other
  misc_feature (486)..(488): n is a, c, g, or t
  modified_base (490)..(492): a, c, t, g, unknown or other
  misc_feature (490)..(492): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagataaccgaactgtggctgcacatctgtcttcatccttcccgccactctcgaactactcacactgacgcgggcgtggacgaaggccgacacgtagnngnnncnnn

SEQ ID NO: 143855 - DNA, 519 bp, Homo sapiens
  misc_feature: GYAE6OF02HPPLR.43.71.G05.1.454.CMB.1.raw
  modified_base (394)..(394): a, c, t, g, unknown or other
  misc_feature (394)..(394): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcactcccagacaggttcagtggcagtgggtctgggacagacttcactctcaccgtcagcagactggaccctgaagtattttgcagtgttattactgtcagcagtatggtagctacacgatcaccttcggaccaagggacacgacgtggaanacgttaaccgaactgtcggctgcaccatctgtccttcatccttcccgcctatcctagaacctactcacctactgacgcgggccgtggaccgaaggccgactagtaacgcncncgtancgatcngn

SEQ ID NO: 143856 - DNA, 528 bp, Homo sapiens
  misc_feature: GYAE6OF02F87IC.43.71.G05.1.454.CMB.1.raw
  modified_base (520)..(521): a, c, t, g, unknown or other
  misc_feature (520)..(521): n is a, c, g, or t
  modified_base (523)..(524): a, c, t, g, unknown or other
  misc_feature (523)..(524): n is a, c, g, or t
  modified_base (527)..(528): a, c, t, g, unknown or other
  misc_feature (527)..(528): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactcggaccctgaagtattttgctagtgtattactgtcagctagtatggtagctcgaccgatccaccttcggaccgtaagggacacgacgtggacgtaacttaacccgaacgtgtacggctcgctaccatcgtgtcttcactccttcccgcctatctactaaccttcactactacgtcgacgccggtcgcggacgaacggcgtacgacttaggcacnngnntcnn

SEQ ID NO: 143857 - DNA, 538 bp, Homo sapiens
  misc_feature: GYAE6OF02HXTK8.43.71.G05.1.454.CMB.1.raw
  modified_base (530)..(530): a, c, t, g, unknown or other
  misc_feature (530)..(530): n is a, c, g, or t
  modified_base (532)..(538): a, c, t, g, unknown or other
  misc_feature (532)..(538): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcactcccagacaggttcagtggcaggtgggtcgtgggacagacttcactctcaccgtcagcagacgtggaccctgaagtattttgctagttgtattactgttcagcagtatggtagctcaccgatcaccgttcggaccgaacgggacacgacgtggaacgtataaccgatcggtgctcgacaccattctagttcttactactccttcccgactactcgtacgtaacctactcctaccgtacgtacgacggtccgggtcgtcgggtacgaacggtcgacaagtacgncnnnnnnn

SEQ ID NO: 143858 - DNA, 581 bp, Homo sapiens
  misc_feature: GYAE6OF02GPLC0.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccacgcccccgagggacgggctgggagtggagttgggagtattaccagagtgggagacacctactaccaacccgtccctacaaaacgtcgaacgccaaccatactaccgtagaccgacgtaccaaacgaacctaacttacctccctagaacgctagactctcgtgtcgacccgcgccaagaccgacggcctgtaccttattacgtgtgaccgacggccccgagccgcgtagttcggttctttttcggatttcggtcctttagtagttacgttcgggtacggggaaccgtaacggggacctagttacccggg

SEQ ID NO: 143859 - DNA, 639 bp, Homo sapiens
  misc_feature: GYAE6OF02JTZ0I.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtcggctcatcagcagcagtacttacttcgtgggctgactccgccacgccccgagggacgggctggacggtggagttggggacttacgttaccgacgaggtagggacgcctaaccgttacctaacctaaccccggtaccctaacgaaacgtcgaacggccaacctagtacgtaccgtaagacctaaccgtaccgaaacgtaaacctaacttcctacccgtagaacgtcgttagactcgttacgtcgttacgacccgaccgcgtaacgaccgaccggtcgtcgtactacttacgtcgtacggccgtaaccggccccgaagccgtcgacggtttcggttacttttcggactttcggtaccgttagttagtacggttcggtaccggggtacaacgggtacgttacggttaccgg

SEQ ID NO: 143860 - DNA, 623 bp, Homo sapiens
  misc_feature: GYAE6OF02G5GSC.43.71.G05.1.454.CMB.1.raw
tcagtgtgagtagtcacgaccggtgctcgatttagtgtcgtcgcaagagagaggggggagagggaaccatggaaacccagcgcagcttctcttcctcctgctacgtctggctcccagggaaagagccaccttctcctgcaggtccagtcaggagtcgttaccaacgactacttacgcctggtaccatcagaaacctggccaggctcccaggctcctcatctacggtgcactcagcagggccactggcatcccgagactagttcagtgcagtcggtctcggacagacttacactctcacgtcagcacgactcggacctgaacgtatttggctagtgtattactgtcacgacagtatgggtagcctacgaccgatccaaccgtttcggaccctaacgggaccaccggtacgtacgggacgtaaacgttaaaccggaacgttggtcgggacttacggtcctaaacccgtgttccttcggttcctttactaacgttcccgtttccccgacctaacgtttccgtaacgttaaaccttaccttacgaaccgtacggtcgggaacgtccgggtacgtcgggacgaagggccgacgtaacgtacgggctacggctacgcgtcgtcgtacgc

SEQ ID NO: 143861 - DNA, 511 bp, Homo sapiens
  misc_feature: GYAE6OF02HWE87.43.71.G05.1.454.CMB.1.raw
  modified_base (351)..(351): a, c, t, g, unknown or other
  misc_feature (351)..(351): n is a, c, g, or t
  modified_base (504)..(504): a, c, t, g, unknown or other
  misc_feature (504)..(504): n is a, c, g, or t
  modified_base (506)..(511): a, c, t, g, unknown or other
  misc_feature (506)..(511): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggcctcctcatctacggtgcatccagcagggccactggcatcccagacaggttcagtggcagtgggtctgggacagacttcactctcaccgtcagcagactgaccctgaagtatttgcagtgtattactgtcagcagtatggtanctcacgatcaccttcggaccaagggacacgacgtggacgactaaccgaactggtcgctgccacatctgtcttcacttctcccgctactcgtacgtaacctactacactactcggacgcgggtactaggaccgaaggtccgacgtacgtagcgncnnnnnn

SEQ ID NO: 143862 - DNA, 654 bp, Homo sapiens
  misc_feature: GYAE6OF02H7R27.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggcctgtcccagctgcagctgcaggagtcgggcccaggactggtgaagcccttcggacaccctgtccctcacctgcactgtctctggtgctcatcagcagcagtacttacttcgtggggctggactccgccacggcccccgaggggacggggctgggaggtggagttcgggagttaatttaccacgtaggtgggacgccgtacctaccgtaaccaaccccgttccctaacgaaaacggtcgaacggccacctaatactaccgaacgtaccaacgtaccaaacgaaccctaacttcctacccgtagaacgcgtacgacgtcctgtacggttcgaccccgccgacaacgaccgacggtcttgttaccttactttacgtggttacggacccgacgggtacccccgagtccggacgtaggtttccggttcgttttttggaacgtttcggttaccgttttagaacgtttacgggttcgggtaccggggaaccgtaaagggtaccgttaaggttccggg

SEQ ID NO: 143863 - DNA, 663 bp, Homo sapiens
  misc_feature: GYAE6OF02FZETJ.43.71.G05.1.454.CMB.1.raw
  modified_base (333)..(333): a, c, t, g, unknown or other
  misc_feature (333)..(333): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagcagtacttacttcgtgggctggactccgccacgcccccgaggggacgggctgggaggtggagttgggagtatttaccgagtaggtgggancacctactaccgaacccgtcctacaaaacgtcgaggcaaccatactaccgtagacctacgtaccaacgaacctaacttcctcccgtagaacgtctaggacgtctacgtggttacgacccgaccgtacgaacgaccgaccgggtccttcggtaccttacgtttaccgttcggtacggaccggaccgggccccgaagggcccgtacgtacgggttacggttccgtttttttaggaacgtttccggttacccgtttttacggtaacgtttacgggttcggggttacgggggtaaccccggtaaaggggtaacccgtaacgggtttacccgggg

SEQ ID NO: 143864 - DNA, 575 bp, Homo sapiens
  misc_feature: GYAE6OF02G1Q9P.43.71.G05.1.454.CMB.1.raw
  modified_base (356)..(356): a, c, t, g, unknown or other
  misc_feature (356)..(356): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (574)..(575): a, c, t, g, unknown or other
  misc_feature (574)..(575): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggtcagtgcagtgggtctggacagacttcactctcaccgtcagcagactggaccctgaagtatttgactagtgtacttacgtgtacagtcagtagtggtacnctcgacgatccaccgttccggaccaagggaccacggtacgtaggaacgtaacgttaaacccgaacgttggtacggctaccgacctaaccgtattccgttcgttaccttaccttacctttacccgactacttcgtacgtaaccttactaccaactcgtacgacggccgggtgtacggacggtacggaccgacgtaacgtacgcgtgactcgancgntcnn

SEQ ID NO: 143865 - DNA, 708 bp, Homo sapiens
  misc_feature: GYAE6OF02HS9V7.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcctcacctgcactgtctctggtcgctccatcagcagcagtacttacttcgtggggctggactccgccacgcccccgaggggacgggcgtgggaggtggtacgttaggggtagttaactttaaccgacgtaggtacggggacgtaccaaccgtaacctaacccgaaccccgttaccctaaccgaaaaacggttccggaacggacctaacccgaattaccgtaccggtaacgaaccgtaaccgtacccgaaaacgtaaaccctaaacgtttacccgtacccctaaggaaccgtactacggacgtaccgttacgtacggttacccgaccccgggccgtaccgaacgaaccgaccgggtcttcggttacttacgtttacgtcggtacggaccggaaccgggccccgaagtccgacgtacggttcggtttcgttttcggacttcggttcccgtttagtagttacggtcgggtaccggggaaccggtaacgggtacgtagttaccggg

SEQ ID NO: 143866 - DNA, 550 bp, Homo sapiens
  misc_feature: GYAE6OF02HLAEZ.43.71.G05.1.454.CMB.1.raw
  modified_base (224)..(224): a, c, t, g, unknown or other
  misc_feature (224)..(224): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (548)..(550): a, c, t, g, unknown or other
  misc_feature (548)..(550): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtncatccagcagggccactggcatcccagacaggttcagtggcagtgggtctgggacagacttcactctcaccgtcagcagactcggaccctgaagtattttgctagtgtattactgtacagctagtatggtagctaccacgtatcctaccgttcggaccgaacgggacacgacgtggaacgtaacttaaaccgaactggtacggctacggccaaccgtattccgttcgtaccttcacttccttcccgcctactctacgtaacctactccactactgacgcgggtctacgggacgaacggccgtacgaagttacgntcncngnngnnn

SEQ ID NO: 143867 - DNA, 701 bp, Homo sapiens
  misc_feature: GYAE6OF02GVNG5.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaagtccttcggacgaccctgtccctcacctgctactgtctcgtggtcgcctccatcagcagctagttacttacttcgtgggctggactccgccgacgccccgaggggacgggcgtggagtggagttgggacgttacttaccgagaggtgggacgacctaccgtaacctaaccgtaacccgtaccctaacgaaaacgtcgaacggccaacctatacgtccgtaacgaccaacgtacccaaagaaccctaactttccctacccgtagacgtcgtacgacgtcctcgtcggttacgaccccggccgacgaacggtaccgaccgggtcgttacggttaccgtttacgtttaccggttacggttacggaccgggtaaccgggcccccggtaagtcccggaacggttacggtttccggtttccgtttttaggacgttttcggttaccgttttacggtaagtttacggttcgggggtcccggggtaaaccgtaacgggggttacctaaggtttacccggg

SEQ ID NO: 143868 - DNA, 578 bp, Homo sapiens
  misc_feature: GYAE6OF02HZ7QX.43.71.G05.1.454.CMB.1.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcagggagtcgggcccaggactgggtgaagccttcgggagaccccttgtccctcaccctgcactgtctctggtcgctccatcagcagcagtactttttactcgtgggctggatccgccacgccccgaggggaagggctggngtggatgggatattaccanagtggagcacctactacgaacccgtcctacaaagtcgacggacaccaatactaccgtaagaccgaccgtaccaaacgaacccatttacctaccctagaacgctagacgtctcgtcgtacggaccgtccgacagtaaccaccggcttagtacttacttacgtggtcgaccgtacggccccgagcgctaggttggttcttttgattcgtccttttagagttacgtgggtacgggaccgtaaaggggtacaaggttcgg

SEQ ID NO: 143869 - DNA, 512 bp, Homo sapiens
  misc_feature: GYAE6OF02F49CO.43.71.G05.1.454.CMB.1.raw
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
  modified_base (506)..(506): a, c, t, g, unknown or other
  misc_feature (506)..(506): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccagggactggtgaagccttcggagacccctgtccctcaccctgcactgtctctggtggcctccatcagcagcagtacttacttctggggctggatccgccagcccccaggggaacggggctgggagtggagttgggagtatttaccacagtgggagcacctactacaacccgtcctacaaagtcgaggcacatatccgtagacacgtccaagaaccaattctaccctgaagctagagctctgtcgaccgcgcacgacacggctgtctnttactgtgcgacgcccgagccgnagtgtcttttggatgcctttgatgtgtgggccaaggganagtcgg

SEQ ID NO: 143870 - DNA, 612 bp, Homo sapiens
  misc_feature: GYAE6OF02JNG1D.43.71.G05.1.454.CMB.1.raw
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
  modified_base (334)..(334): a, c, t, g, unknown or other
  misc_feature (334)..(334): n is a, c, g, or t
  modified_base (594)..(594): a, c, t, g, unknown or other
  misc_feature (594)..(594): n is a, c, g, or t
  modified_base (600)..(600): a, c, t, g, unknown or other
  misc_feature (600)..(600): n is a, c, g, or t
  modified_base (605)..(605): a, c, t, g, unknown or other
  misc_feature (605)..(605): n is a, c, g, or t
  modified_base (610)..(611): a, c, t, g, unknown or other
  misc_feature (610)..(611): n is a, c, g, or t
tcagtgtgagtagtcacgaccggtgctcgatttagtgtcgtcgcaagagagagggggaggagggaaccgatggaaacccagcgcagcttctcttcctcctgctactctggctcccaggggaaagagccaccttctcctgcaggtccagtcagagtcttaccaacgactacttagcctggtaccatcagaaacctggaccaggctcccaggctcctcatcctaggtncatccagcagggccaatggcactcccagacagtcagtcgcagtggtcnggacagacttcactctcaccgtcagtcagctgacctgaatactttgcagtgtacttacgngtcgagtacgtagtacgttggtagcctacgtaccgacttaccgtacctttaccgggggacccaaaggggtaccctaaccggacgttacgggtaaacggtaaacgtttaaacccgaaacgttcgggttacggacgttacgaccctaccgaattccgttacgttagttacctctacccgttcccgaccgtacttacccgtagtaaacctccgtactaccgtactagacggccgcgtacgacggaaggcctaacacggttacngtacgngctanacgcnnc

SEQ ID NO: 143871 - DNA, 521 bp, Homo sapiens
  misc_feature: GYAE6OF02G58JT.43.71.G05.1.454.CMB.1.raw
  modified_base (443)..(443): a, c, t, g, unknown or other
  misc_feature (443)..(443): n is a, c, g, or t
  modified_base (512)..(513): a, c, t, g, unknown or other
  misc_feature (512)..(513): n is a, c, g, or t
  modified_base (516)..(521): a, c, t, g, unknown or other
  misc_feature (516)..(521): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactcggaccctgaagtattttgctagtgtattactgtcagcagtagtggtagctcacgatcaccttcggccgaagggacacgacgtggagtacgttaaccgagtgtggctgccactctctgtcttctactccgttcccncctattcctacgtaaccttactacctacacctggacgcgggtcgtcgggacgaacgggccgacagtagnngcnnnnnn

SEQ ID NO: 143872 - DNA, 562 bp, Homo sapiens
  misc_feature: GYAE6OF02HZ63B.43.71.G05.1.454.CMB.1.raw
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
  modified_base (502)..(502): a, c, t, g, unknown or other
  misc_feature (502)..(502): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
  modified_base (559)..(562): a, c, t, g, unknown or other
  misc_feature (559)..(562): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtcgtgggacagacttcactctcaccgtcagcaagcgnggacccngaagtnttttgctagtgtattactgtcagctagtagtggtanctcacgtactacctccgttcggaccgaacgggaccacggtactagggtaacgaacgtttaaaccgacgtcggtacggctacgacctaccacttcttcgttccttactacctccttacccgtcctacttccgtactaaccttacncctaccacgtcgacggtcggacgtcggacgaacggcgtacgaagtagngtancgnannnn

SEQ ID NO: 143873 - DNA, 588 bp, Homo sapiens
  misc_feature: GYAE6OF02HZKIX.43.71.G05.1.454.CMB.1.raw
  modified_base (335)..(335): a, c, t, g, unknown or other
  misc_feature (335)..(335): n is a, c, g, or t
  modified_base (582)..(582): a, c, t, g, unknown or other
  misc_feature (582)..(582): n is a, c, g, or t
  modified_base (587)..(587): a, c, t, g, unknown or other
  misc_feature (587)..(587): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctccaggctcctcatctacggtgcatccagcagggccactggcactccagacaggttcagtggcaggtgggtcgtgggacagtacttcactctcaccgtcagcagacgtcgacctagaagtattttgctaggttntacttactgtacagacgtagtagtgtagctacacatacaccgttcggacgaaggacacgtactaggacaacgttaacgtaactgtacggtctacgacctaacctactcgtacgttaccttacgactcccgttcccaccttacctacgttaacgtaaccttaccgtacctaaccgtacgtacgaacgggtccggtacggtacgggaccgtaacgggtccgacgtaacgttaggagccgtagcgagtancgtanc

SEQ ID NO: 143874 - DNA, 669 bp, Homo sapiens
  misc_feature: GYAE6OF02JQOHO.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggacgtcgggcccaggactggtgaagcccttcgggacgaccctgtccctcacctgcactggtctctggtgctaccatcagcagctagtaccttacttcgtgggctgtactccgccgacgaccccggagggacgggtcgtacggagtggtagtagggattacgttaccacgaggtcgggacgacaccgtactaccgaacccgttccacgtaaaacggtcggacgaccgaacacttacgacctagaccgtacgtaccaaacgtaaccctaactttcccgtacccgtacgaaacgtctacgacgtcgttaccgtcggtaccgtacccggaccgtacgaaccggtaccgaccgggtaccgtttacgttaccgttaacgtttaccgtaggtccggaaccggtcccgggacccgtacgccgtacgtacggttccggtttcgtttaacgtcgttcgtccgtttagtacctggttacggtaccgggtaaccggacggtacgtacgttaccgg

SEQ ID NO: 143875 - DNA, 629 bp, Homo sapiens
  misc_feature: GYAE6OF02ILB1L.43.71.G05.1.454.CMB.1.raw
  modified_base (225)..(225): a, c, t, g, unknown or other
  misc_feature (225)..(225): n is a, c, g, or t
  modified_base (628)..(628): a, c, t, g, unknown or other
  misc_feature (628)..(628): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcaagaaacctggccaggctccaggctcctcatctacggtncatccagcagggccactggcactcccagacaggttcagtggcagtgggtctgggacagacttcactctcaccgtcagcagactcggaccctgaagtatttgctagtgtattactgtcagacagtagtggtagctacacgacttacaccgttccggaccgaacgggacaccgacgtacggagtaacgttaaaccggaacgttggacggtacgtgaccgaacctactttccgttcgttaccgttactacgttcccgtttccccgacccttacttacccttaaggttaaacccttaccgttaccctaaccgtaaccggttacgggtaccgggtacccgggtcgtaacggggtaccggtaaacgggtacccggtacgtaacggttacgagtacgctacgacactganc

SEQ ID NO: 143876 - DNA, 772 bp, Homo sapiens
  misc_feature: GYAE6OF02GWSNH.43.71.G05.1.454.CMB.1.raw
  modified_base (228)..(228): a, c, t, g, unknown or other
  misc_feature (228)..(228): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcggcccaggactggtgaagccttcggagaccctgtccctcacctgcactgtctctggnggctccatcagcagcgtacgttacttcgttcggtcgggcgtggaccgtcccgaccaccggaccccggaagggggacgggtcgtacgggtaggtcggtaggttgggtaacgtttaaccgtttaaccgaacgtaggggtacggggacacccgtaaccgttaaccgtaaccccgtaaccccgttacccgtaaaacgtaaaccggtacggaacggtaccctaaccgtaaacttaaccggtacccggtaacgaacccgtaacccgtaacccgaaaaccgtaaacccttaacctttaccccgtacccgttaaagggaaccctcgtaacgaccgttcttaccggtggtacccgacccggtccgacgaaacggcccgaacggttcgttacggttaccttacgtttaccgtgggttaccgaccgggaaccccgggtcccgtaagcccgtaacggttcggtttcggtttacgtttttggaaccgtttccgtttacgtttacgttaagtttcgggtagggtaccgggtaaaccggtaacggtacttaggtcccgg

SEQ ID NO: 143877 - DNA, 653 bp, Homo sapiens
  misc_feature: GYAE6OF02IAQL7.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaacgccttcggagaccctgtccctcacctgcactgtctcgtggtcgctccatcagcagcacgttacttacgttcgtgggctggactccgccacgccccgagggacgggcgtggagtggtagttgggtagttactttaccgacgtaggtcgggacgactacctaaccgtacccgaaccgtaccctaacgaaaacggtacgaacggaccaacctaacttacgtaccggtaacgaacctaaccgtaaccaaacgtaaccctaaactttccctaacccgtagaacgtcgtacgaactccttcgtcggtacgacccgccgacgacgaccgacggtcttagttaccttagtttaccgtggttcgccggaccggcccgacggcgcgtaggttcggtttcgttttacggacgtttcgttaccgtttagagttcgttacgggaccgggtaacgaacgggttacctagttacccgg

SEQ ID NO: 143878 - DNA, 664 bp, Homo sapiens
  misc_feature: GYAE6OF02JAAV6.43.71.G05.1.454.CMB.1.raw
  modified_base (165)..(165): a, c, t, g, unknown or other
  misc_feature (165)..(165): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctctgctggtggcgctccagatgggtcctgtcccagctgcagctgcaggngtccgggcccaggactggtgaagtccttcggacgaccctgtccctcacctgcactgtctcgtgggtgcctccatcagcagctaggttacttacttcgtgggctggactcccgaccacggccccgaggggacggcgtggacggtggagttagggattactttaccgagtaggtgggacgacctacctaccgtaacccaacccgttacccctaacgaaaacgtccggaaggccaacctaagtacgtaccgtaagaccgtacgtacccaaacgtaaccctaacttccctacccgtagaacgtcctagacgtcctacgttcggtacgacccgccgacgaacgaccgaccggtcttcgtacgttacgtacgttggtacgaccggaccggccccgaggccgtcggtacgttcgggtttactttttcggaacgtttccggttaccgttttagaacgtttaggttcgggtacggggtaaccgtaaggggtaacctaggttacccggg

SEQ ID NO: 143879 - DNA, 643 bp, Homo sapiens
  misc_feature: GYAE6OF02JEUWX.43.71.G05.1.454.CMB.1.raw
  modified_base (331)..(331): a, c, t, g, unknown or other
  misc_feature (331)..(331): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagcagtacttacttcgtggggctggactccgcacgccccgaggggacggcgtggaggtggagttgggattacttaccgacgtaggtgggacnctaacctactaaccgaacccgtcctaacgaaaacgtcgaacggaccaacctaattacgtacccgtaagaaccgtaaccgtaccaaacgaaaccctaactttccctaccccgtagaacgtctagacgtccgtcgttcggtaccgacccgccgacgacgaccgacggtcttagttaccttacgtttacgtcggtacgaccggtaaccggccccggaaggccgtacgtacggttcggtttcgttttaggacgttcggttccgtttagacgtttaggtcgggtaccgggaaccgtaagggtacctaaggttaccgg

SEQ ID NO: 143880 - DNA, 650 bp, Homo sapiens
  misc_feature: GYAE6OF02J1H4B.43.71.G05.1.454.CMB.1.raw
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
  modified_base (380)..(380): a, c, t, g, unknown or other
  misc_feature (380)..(380): n is a, c, g, or t
  modified_base (639)..(639): a, c, t, g, unknown or other
  misc_feature (639)..(639): n is a, c, g, or t
  modified_base (643)..(643): a, c, t, g, unknown or other
  misc_feature (643)..(643): n is a, c, g, or t
  modified_base (646)..(646): a, c, t, g, unknown or other
  misc_feature (646)..(646): n is a, c, g, or t
  modified_base (648)..(649): a, c, t, g, unknown or other
  misc_feature (648)..(649): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctacctcatctacggtncatccagcaggccactggcactcccagacaggttcagtggcagtggtctggacaggtacttcgactctccaccgtnagcagacgtcggaccctagaacgttattttacgcgtacgttagttacttacgtcgtactagactaggtagtacggtacnccgttaccaacggtcttccgacccgtttcggacgtaacgggaccgacgtacgtaggtaacgtaacgttaacccggaagttcggtacggtaccgtacgaccgtaaccgtagtttacgttacttaccgttctaaccgttacccgttaccccgttccgttaactcccgttaaacgtaacccgttaaccttccgaaaccttacggacgttaccgggcgggtacctacgggtacgaccgggtaccacggtaacgtgtcgctacncganacncnng

SEQ ID NO: 143881 - DNA, 600 bp, Homo sapiens
  misc_feature: GYAE6OF02JYTLU.43.71.G05.1.454.CMB.1.raw
  modified_base (270)..(270): a, c, t, g, unknown or other
  misc_feature (270)..(270): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (467)..(467): a, c, t, g, unknown or other
  misc_feature (467)..(467): n is a, c, g, or t
  modified_base (513)..(513): a, c, t, g, unknown or other
  misc_feature (513)..(513): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (563)..(563): a, c, t, g, unknown or other
  misc_feature (563)..(563): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccagggactgggtgaacgccgttacggacgaccctcgtccctcaaccttgccatgtctctggtcgctccatcagcagctacgtacttacgttcgngggactggactccgccaccggcccgaaggggacggcgaggagaggtagtgggaattacttaaccngaggtggggacnctaaacccgtacgaccaaaccccggtttcaacgtaaaacggtccgaacggacaaccttataaaccgtcggtaacacctaacggtaccaaaggaaacctaattccgtacagaactcgtganacttcagtcgaccgcaccagacgttcgactcgtactattctggccncgaccggtacccgngaccgngtagttcgttcgttagtcgttcttacgttnaagttcggtcgggacggtaaggtaacggtactagtcg

SEQ ID NO: 143882 - DNA, 640 bp, Homo sapiens
  misc_feature: GYAE6OF02IBDXC.43.71.G05.1.454.CMB.1.raw
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcaagaaacctggccaggcctccaggcctcctcatctacggtgcatccagcgagggccacgtggcactcccagacacggttcaggtggcaggtgggtcgtagggactagtacttcgactctccacgtnacgcagacncggaccctgaaacgtntttgactagtgttactactgtacagctaagttagtaggtactactcgaaccgtattacctaacccggttccggaacgaagggacacggtagtacgggaataacgttaaacgacgttaggtcgacctaggaccaacctacgtcgttacgttccttataccttcccttacccgtaccgttaaacttccggttaacgtaaacccttccttaaccaaccgttaacggtacggtaaccggggtcccggtacggttaccgggaacgtaacggccgtaccgtaacgtaacggngacgngacncganctntn

SEQ ID NO: 143883 - DNA, 766 bp, Homo sapiens
  misc_feature: GYAE6OF02JSZO5.43.71.G05.1.454.CMB.1.raw
  modified_base (203)..(203): a, c, t, g, unknown or other
  misc_feature (203)..(203): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtaggcggctcccagatgggtcctgtcccagctgcagctgcagggagtcgggcccaggactggtagaagccttcggganaccctgtccctacacctgctactggtccttcgtgggttcggcctaccgactcacgacacgctacgtacttacttcgtcgggtcgtggacgtccgcccaccgaccccggacggggacggggtcggtacgggtaggtgggtacgttacgggtaagttacgaacccgttttttttttacgacggtacggggacgtacgtaaccgtaccgtaacccgtaaccccgttacccgtaaccgtaaaaccgtacggtacggacctaaccgtacgtacgtaccgtaacgtaccgaaccgtaccgaacgtaaaccctaacgttacctacccgtacgaacgtcgtacgacgtcctacgtcgttaccgtacccgaccgtccgaacgaccgtaccggacgttacgtaccgttaacgttaaccgttcggtacggtaccggtaccgggtacccggtaccggtaccggtacggtacggtacggttaccggttttacggttacggttacgttaccgtttacggtacgttacgggttaacgggtccgggtaaccggtaaccgggtacggtaacgttaccggg

SEQ ID NO: 143884 - DNA, 758 bp, Homo sapiens
  misc_feature: GYAE6OF02IS1J0.43.71.G05.1.454.CMB.1.raw
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (705)..(705): a, c, t, g, unknown or other
  misc_feature (705)..(705): n is a, c, g, or t
  modified_base (716)..(716): a, c, t, g, unknown or other
  misc_feature (716)..(716): n is a, c, g, or t
  modified_base (745)..(745): a, c, t, g, unknown or other
  misc_feature (745)..(745): n is a, c, g, or t
  modified_base (751)..(751): a, c, t, g, unknown or other
  misc_feature (751)..(751): n is a, c, g, or t
tcagtgtgagtagtcacgaccggtgctcgatttagtgtcgtcgcaagagagaggggagagggaaccatggaacccagcgcagcttctcttcctcctgctactctggctcccagggaagagccaccttctcctgcaggtccagtcagagtcttaccaacgactacttagcctggtaccatcaagaacctggccaggctacccaggctcctnanctacggtgctatccagcgagggcccagtcggacctatcccgagacgtagttctaagtggaccgtagtacgggtcgtacggggaacgtaacgtacgttaccgtacgtaccgttaccgacccggttacctaagggcctaaacggtacccgttaaccgggtaacccccggttaacggaaacgtttaaccggttttttcgaacccgttaggttacggtttaaacttaccggtttacggtaccgtaacgtaaccgttaaggtaacggtaggttacgtaccgtacgtaccgtacgtaacccgttacccgttaccgggtaaccgtaacggggtacctaaccggtaccggttaaaggacggttaaacgtaaacccgtaaggttacggtacgggtaccgtaccggaaccgtaccgtacgttaccgtacgttccgttacgtacgtacccgttccccgaccgttactaccgtacgtaccttaactaccgtaactacgttaccgnggtccgtacgngtaccgaacggcgtcaacgttcgacgtancgtacngccatgc

SEQ ID NO: 143885 - DNA, 727 bp, Homo sapiens
  misc_feature: GYAE6OF02G28N0.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtgggctggactccgccacgcccccgagggaacggggctgggacgtggagttgggacgttacgtttaccgacgtagtgggagcaacctaacgtaaccgaacccgtaccctacgaaaaacgtcggtacggaccacccaattaacgtccgtaagaacctaaccgtaccaaacgaaaccctaaactttcctaccccgtagaaacgtacgtacgtaacgtccgttacgtagttaccgggaccccggtacccggaccgaacgggtaacccgaaccgggtaccttacggtttaactttaaccgtttaccgttacgggttacggtcccggtaacccgggcccccggtaaacgccggtaccgtacgggttcggtttaccggttttttaggaaccgtttcggtaacccgttttaggtaaccgtttaagttccgggttaacggggtacccggtaaaacggggacctaaaggtttacccgggg

SEQ ID NO: 143886 - DNA, 713 bp, Homo sapiens
  misc_feature: GYAE6OF02JHZJA.43.71.G05.1.454.CMB.1.raw
  modified_base (246)..(246): a, c, t, g, unknown or other
  misc_feature (246)..(246): n is a, c, g, or t
tcagtgtgagtagtcacgaccggtgctcgatttagtgtcgtcgcaagagagagggggaggagggaaccgatggaaaccccaagcgcagcttctcttcctcctgctactctggctccagggaaagagccaccttctcctgcaggtccagtcagagtcttaccaacgactacttagcctggtaccatcagaaacctggccaggctcccaggctcctcatcgtacggtgcatccagcagggacccacgnggtcactacccaggacctaggttcagtggctaggtggtcgtggggacaggacttaccgactctacaccggtcaagccagacgtcggaccctgtaagtagttttgctagtgtagttaactgtacgagagtacgtagtaggtatctcgaaccgtattccaccggtttaccggacccgtaaagggaccgaaccggtaaccgtcgggaacgttaaaccgtaaaccgtaacgtgggttacggtacgttccgggtaaccaaccgttaaccgttcgtttaccggtacccgtttattaccttaccccgtttacccccgggtaacctacctttaaccgttaacccggttaaaaccgtttacccttaaccgtaaacccttaaccgtacgggtaaaccgggttcccgggtacggtaccggtaccgggaaaccggtacgggtacctaacggttcggatacgcgttacaggctgccaagg

SEQ ID NO: 143887 - DNA, 525 bp, Homo sapiens
  misc_feature: GYAE6OF02G34JU.43.71.G05.1.454.CMB.1.raw
  modified_base (360)..(360): a, c, t, g, unknown or other
  misc_feature (360)..(360): n is a, c, g, or t
  modified_base (431)..(431): a, c, t, g, unknown or other
  misc_feature (431)..(431): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (519)..(524): a, c, t, g, unknown or other
  misc_feature (519)..(524): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggtctgggacagacttcactctcaccgtcagcacgactcggaccctggaagtattttcgctagttgtattactgtcagctagtagtggtanctcaccgtatccaccgttcggaccgaagggacacggacgtggaagtactaaccgactggtcgctgacactntcgtgttcttcacttcctcccgtctatcctagtaaccttctcctaacactggacgtcgggactggacgaacggtcgacagtgngancnnnnnnc

SEQ ID NO: 143888 - DNA, 635 bp, Homo sapiens
  misc_feature: GYAE6OF02GSE3I.43.71.G05.1.454.CMB.1.raw
tcagtgtgagtagtcacgaccggtgctcgatttagtgtcgtcgcaagagagaggggggatgctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggacgaccctgtccctcacctgctactcgtctcgtggtgcctccatcagcagctagttacttacgttcgtggggctaggactcccgccaccggaccccggaaggggtacgggctgggaggtgggagttagggacttacgttaaccgacgtaggtgggacgccaaccgtactaaccgtaacccgtaccgtaacaaaaacggtccgaacggaccaacctattacgtaccgtaacgacctaacgtaccaaacgtaaccctaacttcctaccgtagaacgtctagacgtctcgtcggtacgaccgcgacacgtaccgacggtctacgtctactacgtggtcgacgaccggcccgtagcggacgttaggtcggttcgttttacgacgttcgttccgttagtagttacggtcgggtacgggaccgtaacgggtactaggtccgg

SEQ ID NO: 143889 - DNA, 637 bp, Homo sapiens
  misc_feature: GYAE6OF02FWZOH.43.71.G05.1.454.CMB.1.raw
  modified_base (445)..(445): a, c, t, g, unknown or other
  misc_feature (445)..(445): n is a, c, g, or t
  modified_base (493)..(493): a, c, t, g, unknown or other
  misc_feature (493)..(493): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtcctctggtcggcctccatcagcagcagtacttacttcgtgggctggactcccggaccacggcccccgaaggggaacgggtctggacgtggagttgggtagttactttaccacgaggtggggacaccaacccgttaactaacccgaaccccgtacctacaaaacgtcgacggacaacctatacgtaccgtaagaccaacgtaccaaacgtacctaaactttccnccctagaacgtctgagtcctacgtgcgacccgcacgacgccgaccggnttacgtccttaacgttacgtcggtacgccggtccggaccccggagccggaccgtaggtcggttcgtttttaggacgttccggttaccgtttgtacgtttacgtcgggtaacggggtacctaacggggtacctaaggttacccgg

SEQ ID NO: 143890 - DNA, 559 bp, Homo sapiens
  misc_feature: GYAE6OF02IOHFQ.43.71.G05.1.454.CMB.1.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (434)..(434): a, c, t, g, unknown or other
  misc_feature (434)..(434): n is a, c, g, or t
  modified_base (548)..(548): a, c, t, g, unknown or other
  misc_feature (548)..(548): n is a, c, g, or t
  modified_base (554)..(555): a, c, t, g, unknown or other
  misc_feature (554)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaagagccaccttctcctgcaggtccagtcagagtcttaccaacgactacttagcctggtaccatcagaaacctggccgggctcccaggctcctcgatctacggtgcatccagcagggccactgcatcccagcagtcagtgcagtggtcgtgggacagacttcactctccaccgtcagcagacgtggaccctagagtattttcgntagtntatactgtnagctagtatggtanctacacgctactaccgttcggaccgaagggacacgtacgtggacgacgttaaccgagtgtggtactcgacctacgtattcgtntacttacacttcctacccgtcaacgttacctacgtaaccttacctaccaaccgacgttacgaacgggtcccggacgtcgggaaccgacggtacgaccgtaacgtaggtacacgnctacgnnanan

SEQ ID NO: 143891 - DNA, 622 bp, Homo sapiens
  misc_feature: GYAE6OF02GS347.43.71.G05.1.454.CMB.1.raw
  modified_base (277)..(277): a, c, t, g, unknown or other
  misc_feature (277)..(277): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
tcagtgtgagtagtcacgaccggtgctcgatttagtgtcgtcgcaagagagaggggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcaggtggcaggtcgggtntgggacagacttcactctcaccgtcagcagctaggacctgaagtatttgctagtgtactcttcgcagctaggtntggtacncgtacacgctcgaccgttccggaaccgtaacgggacaacgacgtacgggtaagtaacgtaaccgtacgtcggtaggccgtcgaccgaactacttccgtcgtttaccttacgtacctttcccgttaccccgtacccttaccgttaccttaacgttaaaccctaaccgttacccaaccgtaccgtaccgggtacgggcccgggtcggtacggggtaccggaacgggacccgtaccgtaaggtaccgtgacgtactgctacgnacng

SEQ ID NO: 143892 - DNA, 800 bp, Homo sapiens
  misc_feature: GYAE6OF02GM8AV.43.71.G05.1.454.CMB.1.raw
  modified_base (780)..(780): a, c, t, g, unknown or other
  misc_feature (780)..(780): n is a, c, g, or t
tcagtgtgagtagtcacgaccggtgctcgatttagtgtcgtcgcaagagagagggggagagggaaccatggaaaccccagcgcagcttctcttcctcctgctactctggcctcccaggggaaagagccaccttctcctgcaggtccagtcagagtcttaccaacgactacttagcctggtaccatcagaaacctggccaggctccaggctcctcatctacggtgcatccagcacgggccactggccactccccgaagaccgaggttaccaaggtcggacagggttcggggttcgtaggggaaccgaacgtacctttaccgtaccgttaccgttaccctacccggtaccgaggtccgaaacggtacccggtacgggacccccgttaagggtaaacggttattttttacgggacgttacggtttaggtttaactttacggttaccggtaccgtaacggtaccgtaaaggttacggttacggggttacgtcgttaccgtaaccggttaacttcccgttaacccgtttccggggacccgtaaacggggtacccgaacgtaacccggtagggtaaccggtaaacggtttaacccggtaaccggttcggtacgggtacttaccgggaccctaccgttaaccgttacgtttaccggtttccctttacgtccttttaccccggttacccgtaccgtccttaccgttacgtaacctttaccgtaaccaacctacggtacgtacggccgggtaccgtagggtaaccgacgggccttaacgacgttaacgngtacaggtcagtacgctgag

SEQ ID NO: 143893 - DNA, 794 bp, Homo sapiens
  misc_feature: GYAE6OF02GDEPV.43.71.G05.1.454.CMB.1.raw
  modified_base (212)..(212): a, c, t, g, unknown or other
  misc_feature (212)..(212): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtccagctgcagctgcaggagtcgggcccaggactggtgaacgccttcggagaccctgtcccctnacctgcactgtctctggtgctccatcagcagctagtacttacttcgtgggtctggacttcccgaccacggtacccccgaggggaacgggtcgtacgggtaaggtcggtaagtttggggaacgttaacttttacccgaacgtagggttacggggacgtaccgtaacccgttaacgttaaaccccgtaaaccccgggttaccccttaaacgaaaaaccgggttaccggaaacggaccgtaaaccgaacttaacccgttacccgggtaaaccgtaacccgaaaccggttaaccctaaacggaaaaccctttaaacgtttaccccgtaaccccgttaaggtaaacgtccttaacgggtaacgtaccgtaccgttacggtacggtacccgaccgaccgtaacggaccgtaaccggtctttacgttacttaaggtttaaccgtcgggtaccgtaccggtacccgggtaaccccgaggaccgtaccgtagggttccggtttacgtttttcggactttcggtacccgttttaggtactacggtttgggttacccggggtaccggtaaacggggtacctaaagggttacgg

SEQ ID NO: 143894 - DNA, 923 bp, Homo sapiens
  misc_feature: GYAE6OF02GH2TG.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctctgctggtggcgctcccagatgggtcctgtcccagctgcagctgcagggacgtccgggacccagggactgggtacgaaaggtcccgttacgggacgtaccccttcggtcccctacacccttgcctacgtcgtctcgtgggtcggcctccaagtcgacgccagactaagttaccttacgttcggtgggctggacgtccgccgaccgccccggtaaggggacgggtcgtaggtacggtgggtaacgttaggggaactttaacgtttaccgaacggtaggtacggggactaccgtaaccgttaaccgtaacccgtaacccccgttaccgtaaaccgtaaaaacggtcggaaccggtacctaaacccgttaagtaaccgttacccggtaaacggtaacccgaacccggttaaacccggaaaacccggtaaaaccctttaaaccgtttaccccgtaaccccggttaaggtaaacccggtccttaaacgggtaccgttacccggttacccgtttaccggggtaacccggaacccccgggttaccccggaacggggtaaacccgtaacccgggttaaacccggggttccctttaaccgggttaacccttttaaacgtttaacccggtgggttaacccggaccgggtaccccgggtaacccgttacgggaccggttcccgttacggggtttcgggttttaaccgttttttcggaaccggtttccgttttaaccggtttaggttaaccggtttcgggtaccggggttaacccggggtaaccggtaaaccggggttaccgtaacgggttacccgg

SEQ ID NO: 143895 - DNA, 571 bp, Homo sapiens
  misc_feature: GYAE6OF02FTNEA.43.71.G05.1.454.CMB.1.raw
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggccaggactggtgaagccttcggagaccctgtcccctcacctgccactgtctctggtgctccatcagcagcagtacttacttcgtgggctggactccgccacgcccccgagggaacggggctggagtggagttggggagttactttaaccacgtagtggggagcacctactaccaacccgtcctacaaagtcgagcacatactcgtagacacgtccaaagaaccaatttcctaccctagaagtctagacgctcgtgtacgaccgtcgcacgacacggctacgtactagtacgtgtcgaccgcggcccgagccgcgtaggtcgttacgtttttcgacgttcgtaccgtttagacgtttagtcgggttacgggaccgtaacgggtacgtaagttaccggg

SEQ ID NO: 143896 - DNA, 776 bp, Homo sapiens
  misc_feature: GYAE6OF02H2CLW.43.71.G05.1.454.CMB.1.raw
  modified_base (760)..(760): a, c, t, g, unknown or other
  misc_feature (760)..(760): n is a, c, g, or t
  modified_base (766)..(766): a, c, t, g, unknown or other
  misc_feature (766)..(766): n is a, c, g, or t
  modified_base (772)..(772): a, c, t, g, unknown or other
  misc_feature (772)..(772): n is a, c, g, or t
tcagtgtgagtagtcacgaccggtgctcgatttagtgtcgtcgcaagagagagggggaggagggaaccatggaaacccagcgcagcttctcttcctcctgctactctggctcccaggggaaagagccaccttctccctgcaggtccagtcagagtcttaccaacgactacttagcctggtaccatcaagaacctggccagctccaggtcctcctcatccgtacggtgcatccacgcgacgggcctacgtggccacctccgacgactaggttcgaggtcggcggtaggtcggggtgtacggggtaacgacgtaacgttccaccgttccctaccgtaacccgtcgtacggaccgacgtaaccggtccggtaaccctaggtaaacgtttacgttttacggaccgttagttaggtttaacgttaccttcggtaccgacggtaaccgtagttaagttacgggtaccggtactaccggtaacccgtaacgttaccccgtaccccggttaacccggaaccggttaaaccggggacccgtaaccgtaacggttacgggtaaacgtaaccgttaaaccggtaaccgtggggtaccgtccggtaccgacgtaaacccgttacgttacgttccgttacctttaccgtaccgttaccccgttacccgttcctaaccttccgttaccgttaaccttaccctactcgtaaccgtggaccgggtcgggtaccgtgggaaccgacgggttccgaccgttaagtacgcggttactancgaacngtaccngtac

SEQ ID NO: 143897 - DNA, 730 bp, Homo sapiens
  misc_feature: GYAE6OF02JVP6T.43.71.G05.1.454.CMB.1.raw
tcagtgtgagtagtcacgaccggtgctcgatttagtgtcgtcgcaagagagaggggatgctttctgagagtcatggatctcatgtgcaagaaaatgaagcacctgtggttcttcctcctgctggtggcggctcccagatgggtcctgtcccagctgcagctgcaggagtccgggcccaggactggtagaacgccttcggacgaccctgtcccctcaccttgccactgtcctcttgggtggccttccatccacgcagcacgtacttacttcgtgggtctcggacgtccgaccaccggcccccgaggggaacggcgtacggaggtcggtaggttcgggaacgttacgtttaacccacggtacggtaggggacgtccgtaaccgttaacctaacccgtaaccccgtacccgtaacgaaaacggttccggaacggtaccgtaacccgtaacttaaccggttaccgtaacccggaacctaaccggttacccaaaaccgtaaccctaaccgtttcccgttaccccgtaggaaacgtaccgttacgacgtaccctcgtacggttcccggaacccgccgtaccggagtacccgacggtcttacggttacctacgttaacgtcgtacggaccgtccggtacccgacgccgacgtacgggtacgtttcggtttaatccgttacgtccgtttagtagttaacggttggtaaccggaccggaaaggttccgaacgttcccgg

SEQ ID NO: 143898 - DNA, 628 bp, Homo sapiens
  misc_feature: GYAE6OF02GSQ8D.43.71.G05.1.454.CMB.1.raw
  modified_base (169)..(169): a, c, t, g, unknown or other
  misc_feature (169)..(169): n is a, c, g, or t
  modified_base (353)..(353): a, c, t, g, unknown or other
  misc_feature (353)..(353): n is a, c, g, or t
  modified_base (544)..(544): a, c, t, g, unknown or other
  misc_feature (544)..(544): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcagggngtccggggcccagggacctgggtgaaacggtccctttcgggactacccctgtcccctacaccctgccactgtcctcgtggtgctccatcagcagcattacttacttcgtgggctggactccgccgacgccccgagggacgggctgggagtggagttgggtagtacttaccgagtaggtggggancctaccttacctaaccaacccgtcctaccgaaaacgtcgaacgcacatactaccgtagacctacgtaccacgaaacctaacttcctaccctaggaaacgtctacggactcgtcgtggttaccgacccgtcccgacgacgaacgtaccggtctacgttcttattacgttgcgtacgtccggccgagtaccgngtacgttcgttacgttttcgacgttcgtcctttagacgttaggtcggttaaccggggtacgtaacggggtacgtagttcccggg

SEQ ID NO: 143899 - DNA, 759 bp, Homo sapiens
  misc_feature: GYAE6OF02F8OH6.43.71.G05.1.454.CMB.1.raw
  modified_base (199)..(199): a, c, t, g, unknown or other
  misc_feature (199)..(199): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcgganaccctgtcccctcacctgcactgtctcgtggtgcctcatcagcagcagtacttacgttcgtgggctggactcccgccacgccccgaggggacgggcgtcggaggtcggtagttagggtacgttaacgtttaccgacgtaggtcggggacgtaccgaacctaccgtaaccgtaaccccgttaccctaacgtaaaacggtccggaacggaccaacctaagtacgtacccggtaacgaccgtaaccgttacccaaacggtaaaccctaatttacccgtacccgtaggtaacgtccgtacgtaacgtccgtaccgttaggtccgtacccggtcccgacgtaaccggaccgtacccgggttacttaccgttaccgtttaacgtttaccggttacggtccggtaccgggaacccggtaccccgggtaagacccggtaccgttacgggtttacgggtttaccgttttttacggaaccgtttccggttacccgtttttaaggacgtttacgggttacggggttaccgggggtaaaccggtaacggggttaccgtaacggttacccggg

SEQ ID NO: 143900 - DNA, 633 bp, Homo sapiens
  misc_feature: GYAE6OF02JLB8I.43.71.G05.1.454.CMB.1.raw
  modified_base (225)..(225): a, c, t, g, unknown or other
  misc_feature (225)..(225): n is a, c, g, or t
  modified_base (303)..(303): a, c, t, g, unknown or other
  misc_feature (303)..(303): n is a, c, g, or t
  modified_base (400)..(400): a, c, t, g, unknown or other
  misc_feature (400)..(400): n is a, c, g, or t
  modified_base (612)..(612): a, c, t, g, unknown or other
  misc_feature (612)..(612): n is a, c, g, or t
  modified_base (622)..(622): a, c, t, g, unknown or other
  misc_feature (622)..(622): n is a, c, g, or t
  modified_base (625)..(626): a, c, t, g, unknown or other
  misc_feature (625)..(626): n is a, c, g, or t
  modified_base (631)..(631): a, c, t, g, unknown or other
  misc_feature (631)..(631): n is a, c, g, or t
tcagtgtgagtagtcacgaccggtgctcgatttagtgtcgtcgcaagagagagggggagagggaaccatggaaacccagcgcagcttctcttcctcctgctactctggctcccgagggaaagagccaccttctcctgcaggtccagtcagagtcttaccaacgactacttagcctggtaccatcaagaaacctggccaggcctaccaggcctctcatctacggtncactccagcaggccactggcactcccagacaggttcacggtcggctaggtcgggtcagggacagtacgttcacgttcncgaccgtcagcagacgtcggaacccgtaagtagtttttcggacctaggttcgttaacgtttacgtcgttacgaagtctaacggttattagggtaacncttaacgacgttacacgttaccttcgggaccgaagggtaaccacgacgtaggaacgtaacgttaaccggaagtggtacgtacgtcggaaccctaacgtactttacgttacgttccgtttacactttaccggtaccctctaagttccctacggtaaccttacgactacgtacgtacggcgttcgggactggaccgaggacgttaccagtaacncgtcgtacgnacnncgatncg

SEQ ID NO: 143901 - DNA, 623 bp, Homo sapiens
  misc_feature: GYAE6OF02IEW3J.43.71.G05.1.454.CMB.1.raw
  modified_base (335)..(335): a, c, t, g, unknown or other
  misc_feature (335)..(335): n is a, c, g, or t
  modified_base (415)..(415): a, c, t, g, unknown or other
  misc_feature (415)..(415): n is a, c, g, or t
  modified_base (542)..(542): a, c, t, g, unknown or other
  misc_feature (542)..(542): n is a, c, g, or t
  modified_base (596)..(596): a, c, t, g, unknown or other
  misc_feature (596)..(596): n is a, c, g, or t
  modified_base (611)..(611): a, c, t, g, unknown or other
  misc_feature (611)..(611): n is a, c, g, or t
  modified_base (615)..(623): a, c, t, g, unknown or other
  misc_feature (615)..(623): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaggggaagagccaccttctcctgcaggtccagtcagagtccttaccaacgactacttagcctggtaccatcaagaacctggccaggcctcccgacggcctcctcactcgtacggtgacactaccgaacgacgggcctaacgtggcactcccagacgtggttcgaggtcggcgaggtcggggtcgtacgggacaggtaccttcgacctctccgtaaccgtnagtccaacggacgttaccggaccgtagtagttactttgacgaggttgttattacgtcgtcaagtcgtagtagtacggtancctacgtactacgtcctaccgtacggacaacggggcctaacggtacgaggtaacgtaacgttaacgtaccggtggtacgacgtacaccacgtcttacggttcctacttccgtaccttcccggtaccncgttacctccgttaacgtactacgacctaccttcgacggcgcggttcgagaccncgggaactcggtaangacnnnnnnnnn

SEQ ID NO: 143902 - DNA, 835 bp, Homo sapiens
  misc_feature: GYAE6OF02ILH6C.43.71.G05.1.454.CMB.1.raw
  modified_base (763)..(763): a, c, t, g, unknown or other
  misc_feature (763)..(763): n is a, c, g, or t
  modified_base (779)..(779): a, c, t, g, unknown or other
  misc_feature (779)..(779): n is a, c, g, or t
tcagtgtgagtagtcacgaccggtgctcgatttagtgtcgtcgcaagagagaggggatgctttctgagagtcatggatctcatgtgcaagaaaatgaagcacctgtggttcttcctcctgctggtggcgctcccagatggtcctgtcccagctgcagctgcaggagtccgggccaggctggtagaacgccgttggaacgccctcgtccctcaccgtgcacgttgtctcgttggtcgcttaccatcagactacggacttaacgttaacctttacgttcggtcggggtacctacggtaccttccccggtaccgacccgggaaccccccgggtaagggggaacggggttaccgtaggggaaaccggtttgggtaaccggtttgggggtaaactttaacgtttaaccggaacggttagggtacggggaactcccttaaaccggttaacctaaccccgtaaccccgttaccctaacggaaaaacggttcggtaaaccggtacctaaaccgtaattaccgggttaaaccgttaccgaaaccgtttacccggaaacccgtaaaacggtaaccctttaaaccgttccccgttaacccgtacggtaaacgtttccgaagggaacctttccgtaccgttcggttaacccgacccggccgttaacgaacggttacccgtacggttccttaccggttacgttacgtccgttagggaccggtcgaaaccccgggtcccgaggttacctcgttacgggttccggttttcgtttaacnggttaacccggttttntttaggtacgttacgggttaccgggaccggtaacgtaacggtaccgtaacggtccc

SEQ ID NO: 143903 - DNA, 641 bp, Homo sapiens
  misc_feature: GYAE6OF02IHKBF.43.71.G05.1.454.CMB.1.raw
  modified_base (564)..(564): a, c, t, g, unknown or other
  misc_feature (564)..(564): n is a, c, g, or t
  modified_base (600)..(600): a, c, t, g, unknown or other
  misc_feature (600)..(600): n is a, c, g, or t
tcagtgtgagtagtcacgaccggtgctcgatttagtgtcgtcgcaagagagaggggatgctttctgagagtcatggatctcatgtgacaaagaaaatgaagcacctgtggtttcttcctcctgctggtggcgctcccagatgggtcctgtcccagctgcagctgcagggagtccggggcccaggacgtggtcggaacgtccgttcggacgaccccgtcgtccctcaccgtcgctacgtcgttcctcgtggtcgctccatcgagcagctagttaccttacgtcgtgggactcggactccgaccacgcccccgaaggggacgggctgggacgtggagttgggtacttaatttaccgacgtggtaggacgacccgactaaccgtaaccgtacccgtaccctaacgaaacgtcggacggtacaccgaattacgaccgttagaacctacgtaaccgaaacgtaacctaacttcctaccctaggaacgtcgtgaacgtctcgtgtacccggaccgccgacacgaccacggtccttgtacttacttacgtgtacgtaccggcgaccccgtnacgccttaggtcgtttgttttacgcgttcttcttgngttaacgttcgggtacgggtacggaaacggacgtagttcgg

SEQ ID NO: 143904 - DNA, 767 bp, Homo sapiens
  misc_feature: GYAE6OF02IFCGO.43.71.G05.1.454.CMB.1.raw
  modified_base (119)..(119): a, c, t, g, unknown or other
  misc_feature (119)..(119): n is a, c, g, or t
  modified_base (676)..(676): a, c, t, g, unknown or other
  misc_feature (676)..(676): n is a, c, g, or t
  modified_base (711)..(711): a, c, t, g, unknown or other
  misc_feature (711)..(711): n is a, c, g, or t
tcagtgtgagtagtcacgaccggtgctcgatttagtgtcgtcgcaagagagaggggatgctttctgagagtcatggatctcatgtgcaagaaaatgaagcacctgtgttcttcctcctnctggtggcgactcccagactgggtcctgtcccagcctgcagctggcctagggacgtccgggcccaggactggtacgaacgtcccttacgggaaccacccgttcgtccctcgacccttggtacctacgttcggtctccgtgggtccgtctacccgtagtccgacgtacgacgtaccgtaagttaccttacgttccgtagggtctacgggtacaccgcccgtaaccggaccccgtaggggtaaacgggtccttagggacgttcggtaacgttgggtaaacgtttacttaaccgaaggtacgggtacggacgaccgttaaacctaaccgtaaccgtaaccccgtccgtaaaacgtaaacggtaccgaaacggacctaacgtaaacgttaacgccgttaaacgaccgtaccgtaacccgtaaaagtaaccgttaaacgttcccctaaccgtacggaacgttacacggtacctacgtcgtaagtcccggaaacgtccgagtaaccgacgtaccgtcttacgtactttaacgaacggttcgacgtaccggaccgtacggacgngaccgttgaccggtttcgttcgtaacgttacccgngtttaaccgtgttaccggtaggaccggtaacggaaccggtaccgtaagttacccgg

SEQ ID NO: 143905 - DNA, 676 bp, Homo sapiens
  misc_feature: GYAE6OF02JC79S.43.71.G05.1.454.CMB.1.raw
  modified_base (228)..(228): a, c, t, g, unknown or other
  misc_feature (228)..(228): n is a, c, g, or t
  modified_base (443)..(443): a, c, t, g, unknown or other
  misc_feature (443)..(443): n is a, c, g, or t
  modified_base (663)..(663): a, c, t, g, unknown or other
  misc_feature (663)..(663): n is a, c, g, or t
  modified_base (671)..(672): a, c, t, g, unknown or other
  misc_feature (671)..(672): n is a, c, g, or t
  modified_base (675)..(676): a, c, t, g, unknown or other
  misc_feature (675)..(676): n is a, c, g, or t
tcagtgtgagtagtcacgaccggtgctcgatttagtgtcgtcgcaagagagagggggagagggaaccatggaaaccccagcgcagcttctcttcctcctgctactctggctcccgaggggaaagacgccaccttctcctggcaggtccagtcagagtcttaccaacgactacttagcctgtaccatcaagaaacctggaccaggctcccaggctcctcatctacggtnctactccgagccgacgggccacgtcggactacgtcccaggacctaggttcaaggtcggcgtaaggtcgggtcgtacgggtaccaggtaccttcaacccgttcgtacccgtaacccgtcgaacgtccgtaacgaaccgtcgggtaccctaaggtaagttacttttagacgtgttacgttaacttactggtacagtacgtaagtacgtacgggtacnccgtacgaccgtcgtacccgtaccgtacggaccgaacggacgtacgtacgaggtaacgtaaacgtaccgtacgtcgtacggtacgtacgactaacgttacgttccgttacttccgtcgtacctttaccgttacccgactaccgtaccgtacgtaacctactacctaaccgttacggacggtccgtaccggtcgtacggacgtaacgactacgaactacgntagctctnntcnn

SEQ ID NO: 143906 - DNA, 662 bp, Homo sapiens
  misc_feature: GYAE6OF02F009P.43.71.G05.1.454.CMB.1.raw
  modified_base (147)..(147): a, c, t, g, unknown or other
  misc_feature (147)..(147): n is a, c, g, or t
  modified_base (212)..(212): a, c, t, g, unknown or other
  misc_feature (212)..(212): n is a, c, g, or t
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
tcagtgtgagtagtcacgaccggtgctcgatttagtgtcgtcgcaagagagagggggatgctttctgagagtcatggatctcatgtgcaagaaaatgaagcacctgtggttcttcctcctgctggtggcggctcccagatgggtccngtcccagctgcagctgcaggagtcgggcccaggactggtgaagccttcggagaccctgtcccctnacctgcacgtgtctctgggtgacctccatcagcagcagtactacttcngggctggatccgccacgccccaggggaacggctggacgtggagttgggattacttaccaacgaggtggggacncgtaacctacgtaaccaaccccggttccctacgtaaaacggtcggaacggacctaccgaattacttaccggaagtaaccacggttacccgaaacgtaaacccgaactttaccgtaccccgttacggtaaacgcgttacgtacggaccttacgtacggtacgcccggacccgtacgaaccgacgaaccgggtcttacgacctttaacgtttacgtcggttcggaccggaccggtaccccggagcccgctacggtcggtacgtttttgacgtaccggttccttagtacgttacgttagggttcgggacgttaaccgggacgtaagtccggg

SEQ ID NO: 143907 - DNA, 853 bp, Homo sapiens
  misc_feature: GYAE6OF02H52PF.43.71.G05.1.454.CMB.1.raw
tcagtgtgagtagtcacgaccggtgctcgatttagtgtcgtcgcaagagagaggggatgctttctgagagtcatggatctcatgtgcaagaaaatgaagcacctgtggttcttcctctgctggtggcggctccagagtgggtcctgtcccagctgcagctgcgaggtacgtccggccaggtcgtggtagaacgtccgttacggacgtacccttcgtccctaccaccgttgacctacgttcgttcctcgttggtcggacctaccgatccgagtccagtacgtacgttccgtttaccgttcggtggggtctaacggtccgtcccggacccgaccggtaccccccgggtaagggggtaccggggtccggttaggtaacgggttacgggttacggtttaacggggttaactttaacgttttaaaccccgagggttagggttaccggggtaacgtacccgttaaacccgttaacccgtaaaccccgtaaaccccgtttaccgttaaaccgaaaacggttacccggaaccggtaacctaaccgttaaagtacccgttaccgtaacgtaaccgtaacccgttaaacaaaccgttaaacccttaaacgtttccccctaaccggtaaacgtacgtccgtttaacggccgttaccgtccggtacggtacccggtacccgaaccgccgtaacgtaaccgtccgtaacgttccgtttagtaccgtttaccgtgttccgggaaccgtacccgggacccgtaacgtccggtaccgttacgggtttcttttacggtttacgccggtttacttccgttttaagaccgtttggtccgggtaccggtaacggtaaggtcgtacgttcccgg

SEQ ID NO: 143908 - DNA, 634 bp, Homo sapiens
  misc_feature: GYAE6OF02I9G9X.43.71.G05.1.454.CMB.1.raw
  modified_base (226)..(226): a, c, t, g, unknown or other
  misc_feature (226)..(226): n is a, c, g, or t
tcagtgtgagtagtcacgaccggtgctcgatttagtgtcgtcgcaagagagaggggggagagggaaccatggaaaccccagcgcagcttctcttcctcctgctactctggctccaaggggaaagagccaccttctcctgcaggtccagtcagagtcttaccaacgactacttagcctggtaccatcaagaaacctggccaggcctccaggctcctcatctacggtncatccagcgacgggccacgtggcactcccgaagacaggttcaggtggcaggtgggtctagggacagtacttcactctacgacgtcacgcacgacgtacggacctagtaagtatttgctagttagtacttactgtcaagcgtaagtagtacgggtagtctaccaacgtatacccgtaaccggttcggaaccgtaaagggaccaaccggacggtacggaacgtaaacgttaaaccgaagttacggacggtctacgacctaacctactcgttcgttacttaccgtacttcccgtaccctactactactaacgtaacctactacaactacgtacggacggtccggtacgtacgggacgaacgggtaccggtaactaaggttacgacgtacgacgtcgatacgacggtactgg

SEQ ID NO: 143909 - DNA, 514 bp, Homo sapiens
  misc_feature: GYAE6OF02FY1KY.43.71.G05.1.454.CMB.1.raw
  modified_base (408)..(408): a, c, t, g, unknown or other
  misc_feature (408)..(408): n is a, c, g, or t
  modified_base (445)..(445): a, c, t, g, unknown or other
  misc_feature (445)..(445): n is a, c, g, or t
  modified_base (511)..(511): a, c, t, g, unknown or other
  misc_feature (511)..(511): n is a, c, g, or t
tcagtgtgagtagtcacgaccggtgctcgatttagtgtcgtcgcaagagagagggggagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctccaggctcctcatctacgtgcatccagcagggccactggcatcccagacaggtcagtgcagtgggtctgggacagacttcactctcaccgtcagcagactggacctgaagattttgcagtgttattactgtcagtcagtaatggtagctacaccgatcaccttcggaccaagggacacgacgtaggagattaaaccgaatagtggntgccacatctgtcttcattccttcccgtcacttctanaacttactacaactacgtgaacgccgggtagtcggacgaacgggacgtcgaatacgagatcgatangca

SEQ ID NO: 143910 - DNA, 737 bp, Homo sapiens
  misc_feature: GYAE6OF02I6UPR.43.71.G05.1.454.CMB.1.raw
tcagtgtgagtagtcacgaccggtgctcgatttagtgtcgtcgcaagagagagggggatgctttctgagagtcatggatctcatgtgcaaagaaaatgaagcacctgtggttcttcctctgctggtggcggctcccagagtgggtcctgtcccagctgcagctgcaggtagtccgggcccaggtacgtggtagaacgtccgttcgggacgtaccccgtcgtcccctcacctggacctacgttcgtaccttcgtcgggtcggcctccatcagcagctacgttactttctcggtcgggctggactcccgaccgaccggtccccggaaggggacgggcgtgggacggtggtagttgggaactttacgttaaccgaggtagggtagggactaccgtaaccgttaaccgtaacccgtaacccgttacctaaaccgaaaacgtccggaacgtaccgtaacctacgttaacgtcccggtaaacgtacccgaaccggtaccgaaaacgtaccctaacgtttccgtacccgtaggaacgtcgtacggtacgtcctacgttcgaccgaccggtccacgtaacgtaccgtcggtacgttcgttacgttaacgtttacgcggtacggccggtaccgggcccggagtccggtacgtcggttacgtttcgttttaacgactttccggtaaccgtttggtacgtttacgggtcggggttaccgggaacgtaacgggtaccgtaaggtcccgg

SEQ ID NO: 143911 - DNA, 657 bp, Homo sapiens
  misc_feature: GYAE6OF02JUAP3.43.71.G05.1.454.CMB.1.raw
  modified_base (127)..(127): a, c, t, g, unknown or other
  misc_feature (127)..(127): n is a, c, g, or t
  modified_base (347)..(347): a, c, t, g, unknown or other
  misc_feature (347)..(347): n is a, c, g, or t
  modified_base (512)..(512): a, c, t, g, unknown or other
  misc_feature (512)..(512): n is a, c, g, or t
  modified_base (532)..(532): a, c, t, g, unknown or other
  misc_feature (532)..(532): n is a, c, g, or t
tcagtgtgagtagtcacgaccggtgctcgatttagtgtcgtcgcaagagagagggggatgctttctgagagtcatggatctcatgtgcaagaaatgaagcactgtgttctcctctgctggtggcgcncccagatggtcctgtcccagctgcagctgacgaggtacgtcggacccgaggacgttggtgaacgtcccgttacggaccgtacccgtcgtcccctacaccgtcgacctcgttgtccgtcgtggtacgtccgccgtataccgagacggtaacgcctaagttacgtttacgtcggtacggtcgtcgaccgtcccgccgtaacccgacccgggaggggtaccgntcgggtagtccggaggtttacgggtactacgttaaccgacggtggtccggaacttccgaacccttaggtaaccctccggtaccaagtaacgtcgaacggtaccacggtacttcgacgtacgaccgtaccacgaaaccgtactaacctcgtccgtagactagtcgngtcctacgtcgcgacgccgntacgacgcgtcgtctacgtcctaatcggacctacgccggacccgtgtacgacgtgttcgttacgtcgttacgtcttacggtagtaacggttgttacggccggtaacggaacgttcggtaagtccg

SEQ ID NO: 143912 - DNA, 219 bp, Homo sapiens
  misc_feature: GYAE6OF01BKIZ0.1.74.G08.1.454.CMB.1.raw
  modified_base (217)..(219): a, c, t, g, unknown or other
  misc_feature (217)..(219): n is a, c, g, or t
tcagacgagtgcgtcacgaccggtgctcgatttagtagctctatctcgcggggcctgatgattttgcaacttattactgccaacgatatgacggtttttcgaggacgttcggccaagggaccaaggtggacatcaaacgaactgtggctgcaccatctgtcttcatcttcccgccatctgaacgcactcgtctgagcgggctggcaaggcgcatagnnn

SEQ ID NO: 143913 - DNA, 217 bp, Homo sapiens
  misc_feature: GYAE6OF01CE5V2.1.74.G08.1.454.CMB.1.raw
  modified_base (217)..(217): a, c, t, g, unknown or other
  misc_feature (217)..(217): n is a, c, g, or t
tcagacgagtgcgtcacgaccggtgctcgatttagtagctctatctcgcggggcctgatgattttgcaacttattactgccaacgatatgacggtttttcgaggacgttcggccaagggaccaaggtggacatcaaacgaactgtggctgcaccatctgtcttcatcttcccaccctcctcacgcactcgtctgagcgggctggcaaggcgcatagn

SEQ ID NO: 143914 - DNA, 255 bp, Homo sapiens
  misc_feature: GYAE6OF02IJCL8.1.74.G08.1.454.CMB.1.raw
  modified_base (253)..(255): a, c, t, g, unknown or other
  misc_feature (253)..(255): n is a, c, g, or t
tcagacgagtgcgtcacgaccggtgctcgatttagtagctctatctcgcgggaagatgaagacagatttcactctcaccatcgacaacctgcagcctgaagattttgcaacttttactgccaacagtatattacttacccgtcaccttggccaagggacacgactggagattaaacgaactgtggctgcaccatctgtcttcatcttcccacctctcacgcactcgtctgagcgggctggcaaggcgcatagnnn

SEQ ID NO: 143915 - DNA, 215 bp, Homo sapiens
  misc_feature: GYAE6OF02GTV4N.1.74.G08.1.454.CMB.1.raw
  modified_base (215)..(215): a, c, t, g, unknown or other
  misc_feature (215)..(215): n is a, c, g, or t
tcagacgagtgcgtcacgaccggtgctcgatttagtagctctatctcgcggggcctgatgatttgcaacttattactgccaacgatatgacggttttcgaggacgttcggccaagggaccaaggtggacatcaaacgaactgtggctgcaccatctgtcttcatcttcccaccctcctcacgcactcgtctgagcgggctggcaaggcgcatagn

SEQ ID NO: 143916 - DNA, 221 bp, Homo sapiens
  misc_feature: GYAE6OF02F5CEY.1.74.G08.1.454.CMB.1.raw
  modified_base (217)..(221): a, c, t, g, unknown or other
  misc_feature (217)..(221): n is a, c, g, or t
tcagacgagtgcgtcacgaccggtgctcgatttagtagctctatctcgcggggcctgatgattttgcaacttattactgccaacgatatgacggtttttcgaggacgttcggccaagggaccaaggtggaagtcaaccgaactgtggctgcaccatctgtcttcatcttcccgccatctgaacgcactcgtctgagcgggctggcaaggcgcatagnnnnn

SEQ ID NO: 143917 - DNA, 544 bp, Homo sapiens
  misc_feature: GYAE6OF01AFK59.35.87.H10.1.454.CMB.1.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (395)..(395): a, c, t, g, unknown or other
  misc_feature (395)..(395): n is a, c, g, or t
  modified_base (505)..(505): a, c, t, g, unknown or other
  misc_feature (505)..(505): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagcgtgagtttcctaggtgctatttaaagtgtcagtgtgaggtgcacctggtggagtcgggcggaggcttcgttaagccaggagggtccctaagactctcctgtgcagtttctggattccctttcaatgtcgcctggatgaactgggtccnccaggctccgagggaaggactggagtgggttgcccgnaagttaaaaggngtaattggatggacgggacaacgagactacgcttcacccgttnagggcagattcaccgtctccagagatgattccatgagtactcctgtctctacaatgaactgcctagacaacgagacacagccgtactatactcgtaccactctcgaaccncacgtgacctacttcaaccgacgtagttcggtacggggg

SEQ ID NO: 143918 - DNA, 532 bp, Homo sapiens
  misc_feature: GYAE6OF01BQ6KN.35.87.H10.1.454.CMB.1.raw
  modified_base (269)..(269): a, c, t, g, unknown or other
  misc_feature (269)..(269): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
  modified_base (455)..(455): a, c, t, g, unknown or other
  misc_feature (455)..(455): n is a, c, g, or t
  modified_base (504)..(504): a, c, t, g, unknown or other
  misc_feature (504)..(504): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttcnggattccctttcaatgtcgcctggatgaactgggtccgccaggctccgaggggaaggctggagtgggttgcccgnaattaaaaggngaattgatggcgggacaacgagactacgcttcacccgttnagggcagattcaccgtctccagagatgattccaatgatatcctgtctctacaaatgaacngcctagacaacgagacacagccgtctattactgtacccatctacgaccncactgctactcacagaattcgacggggg

SEQ ID NO: 143919 - DNA, 577 bp, Homo sapiens
  misc_feature: GYAE6OF01C8V54.35.87.H10.1.454.CMB.1.raw
  modified_base (355)..(355): a, c, t, g, unknown or other
  misc_feature (355)..(355): n is a, c, g, or t
  modified_base (417)..(417): a, c, t, g, unknown or other
  misc_feature (417)..(417): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
  modified_base (535)..(535): a, c, t, g, unknown or other
  misc_feature (535)..(535): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcacctggtggagtcgggcggaggcttcgtaagccaggagggtccctaagactctcctgtgctagttttctggtactttccctttcaattgtcgcctggatgaactggtccgccagggcctaccgagggaacggactgggagtgggtcgccccgnaagttaaaagggagaaattggaagtggacgggaacaaacgagactaacgcttacacccgttnacgggcagattcgaccgtctccagagatgacttccatgatatcctgtctctaanaatgaacngcctgaaccaaccgaggacacgagccgtactataccgtcgaaccactcgagaaccncaccgtgaccctacttacaccgtaacaagttcggtacggggg

SEQ ID NO: 143920 - DNA, 649 bp, Homo sapiens
  misc_feature: GYAE6OF01CBLOS.35.87.H10.1.454.CMB.1.raw
  modified_base (289)..(289): a, c, t, g, unknown or other
  misc_feature (289)..(289): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagcgtggtattttccttggtgtcttattttaaaagttgtccagtgtgaggtgcacctggtggagtcgggcggaggcttcgtaagccgaggagggtccctaagactctcctgtgctagtttctggtactttccccttnaatgtcgcctggatgaacgtgggtccgccgaggcctaccgagggaaggactgggaggtgggtcgccccgagtaagttaaaaggagtaaagttggaagtcgggacgggaacaaacgacgacctacgccttacgacccgttcgacgggcagtacttccgaccgtccgtacagagtatgaactttccagtacgagttactccgttgtacctactaacaaacttcgaaacctacgaccgtacgaaccgaacccggaacggaccaacgacgacccgttactaattacctaccgtaacctaccgtctacgaccctacaccgtacgacctacttaccaacgtaaccgtaacgttccggtaccggggg

SEQ ID NO: 143921 - DNA, 719 bp, Homo sapiens
  misc_feature: GYAE6OF01C7KWF.35.87.H10.1.454.CMB.1.raw
  modified_base (454)..(454): a, c, t, g, unknown or other
  misc_feature (454)..(454): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttattttaaaagttgtccagtgtgaggtgcacctggtggagtcgggcggaggcttcgttaagccagggacggtccctaagactctcctgtgctagtttctggtactttccctttcaattcgtccgcctggatcggaacgtcggggtcccgccgtagggcctacccggaagggggaacgggacgttgggggaggttggggttcggccccggtagtaaacgtttaaaaaggggagtaagttggaagtggacgggaacaacgagactacgccttcgacccgttnacgggcagtactcaccgtctaccagacgtatcgactttaccagttacgagttactccgttagtcctacttaaacaaagttacgaaacctacggtacctaacgaacccgtaaaccggaacggaaccaccgtaacggtcccgtaaccttaatttaccgtaccgttaaacccaccgtttaccaccggtaaccctaacgtaccgttaacggcccttaaacctttaccgaaaccggttaccgttaaaggttcccggggtaaccggggggg

SEQ ID NO: 143922 - DNA, 555 bp, Homo sapiens
  misc_feature: GYAE6OF01CDSST.35.87.H10.1.454.CMB.1.raw
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (390)..(390): a, c, t, g, unknown or other
  misc_feature (390)..(390): n is a, c, g, or t
  modified_base (453)..(453): a, c, t, g, unknown or other
  misc_feature (453)..(453): n is a, c, g, or t
tcagtacagatcgtcacgaccggtgctcgatttagcagtactgcgttgggtttggggagctctgggagaggagccccagccttgggattcccaagtgtttcattcagtgatctggactgaacacagaggactcaccatggagtttgggctgagctggattttccttggtgctattttaaaagttgtccagtgtgaggtgcacctggtggagtcgggcggaggcttcgttaagccgaggagggtccctaagctctcctgtgcagtttctggtattccctttcaatgtcgcctggatgactgggtcnccaggctccgagggacggctggaggtggtcgcccgnagttaaaggagtaatgagtggacggacaacgagactacgctcgaccgtnagggcagcttcaccgtctaccagagatgattccatgagtactcctgtactctaacaatgaacngccctagaacaaccgagaccacgacgacctactatacctcgtaaccacgttctcgacccacgacgtacgctacttccaacgtacgtacttcgggtacggggg

SEQ ID NO: 143923 - DNA, 552 bp, Homo sapiens
  misc_feature: GYAE6OF01BEEET.35.87.H10.1.454.CMB.1.raw
  modified_base (412)..(412): a, c, t, g, unknown or other
  misc_feature (412)..(412): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagtgtccagtgtgaggtgcacctggtggagtcgggcggaggcttcgttaagccaggagggtccctaagactctcctgtgcagtttctggattccctttcaatgtcgcctggatgaactgggtccgccaggctccgagggaaggactggagtgggttgcccgcattaaaaggagaattgagtggcgggacaacgagactacgcttcacccgttcagggcagattcaccgtcnccagagatgattccatgagtatcctgtctctaacaatgaactagcctagaacaaccgagacacagcctctatactgtaccactcctgacccactacctggacctaccttacgaaccgtacgaagttccggtaccgggggg

SEQ ID NO: 143924 - DNA, 594 bp, Homo sapiens
  misc_feature: GYAE6OF01BM20A.35.87.H10.1.454.CMB.1.raw
  modified_base (362)..(362): a, c, t, g, unknown or other
  misc_feature (362)..(362): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccgaggagggtccctaagactctcctgtgctagtttctggtactttccctttcaagtgtccgcctggattcgaactgggtcccgccgaggcctccgaggggaagggacgtgggagtgggttcgccccgnaagttaaaaggagtaattgagtgggacggaacaacgagactacgcttccgacccgttcgagggcagtactccaccgtctaccgagagatgatcatgacgtatcctgtctactaacaatnaacngcctagaaccaaccggagaccacgacgcctactacttacctacgtaaccctcgtcctacgaccctacaccgtgacctacttaccaacgtacgtacgttcgggtacgggg

SEQ ID NO: 143925 - DNA, 678 bp, Homo sapiens
  misc_feature: GYAE6OF01DPKCC.35.87.H10.1.454.CMB.1.raw
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggtatttttccgttggtgtacttaatttttaaaagttgtcctagtgtgaggtgcaccgtgggtggaggtcggggcggaggtcttacggttaagccgagggacgggtaccctaagacctctcctgtcgtctagtttctggtactttccctttcaatgtccgccgtggatgaacgtcgggtccgccgtacgggcctaccggaggggaacgggacgtgggtagggttcgggttcggaccccgtagtaaaggttaaaaaggagtaagttggaaggtgggacggaacaaacgagtacctacgtccttaccgacccgttgacgggcaagtacttcccgaccgtctaccgagacgtatacgtacttccaagtagtacgttactccgtgttacctactaacaaatacgaacacgcctacgaaccgaaccggagaaccacgacgaccgttacttacttactaccgtacctaccgtcctacaccacgtcgtacgacctacttacgaacgtacgtaacgtcggtaccggggg

SEQ ID NO: 143926 - DNA, 584 bp, Homo sapiens
  misc_feature: GYAE6OF01APX0E.35.87.H10.1.454.CMB.1.raw
  modified_base (200)..(200): a, c, t, g, unknown or other
  misc_feature (200)..(200): n is a, c, g, or t
  modified_base (400)..(400): a, c, t, g, unknown or other
  misc_feature (400)..(400): n is a, c, g, or t
  modified_base (419)..(419): a, c, t, g, unknown or other
  misc_feature (419)..(419): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtncacctggtggagtcgggcggaggcttcgttaagccagggaggtccctaagactctcctgtgctagtttctggtacttccctttcaatgtcgcctggatgaactgggtccgccaggcctccgagggaaggcgtggagtgggtcgcccgcaagttaaaaggagtaattgagtggacggacaacgagactacgctacaccgtnagggcagactccaccgtcncagacgatgacttccatcgagtactcctgtctactactaactagaacagcctacgaaccgaaccgtaggaccacacgaccctactaattaccgtacgtaccctacctctaccgaccctacacgtcgacctaccgttacaacggtacctagttcggtaccgggggg

SEQ ID NO: 143927 - DNA, 601 bp, Homo sapiens
  misc_feature: GYAE6OF01BV1AO.35.87.H10.1.454.CMB.1.raw
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcggggcggaggcttcgttaagccaggagggtccctaagactctcctgtgctagtttctggtacttccctttcaatgtccgcctggatgaacgtgggtccccgcaggcctccgaggggaaggacgtgggagtgggtcgcccgnaagttaaaaggngtaattgagtggccggaacaacgagactacgccttccgacccgttcgagggcagtacttcgacccgtctccgagacgatgacttccatgattactcctgtcctactacaaatcgaacagcctagaaccgaaccgaggaccaaccgacgtcccgttactaacttaccacgtaacccagttcctacgaccctacaccgtgacctaccttccgaacgacgtacgttcggtacggggg

SEQ ID NO: 143928 - DNA, 607 bp, Homo sapiens
  misc_feature: GYAE6OF01D3ZJZ.35.87.H10.1.454.CMB.1.raw
  modified_base (284)..(284): a, c, t, g, unknown or other
  misc_feature (284)..(284): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccagggagggtccctaagactctcctgtgcagtttctggactttccctttnaatgtccgcctggatgaacgtgggtccgccaggcctccgaggggaagggactgggaggtggggttcgccccgacgaagttaaaaagggagtaattggagtggacgggaacaacgagactacgcttaccacccgttcagggcagacttccgaccgtcctccaagagatgacttccatgagttactcctgtcctactaacaaagtgaacagcctagaaccgaaccggaggaaccacgacgtcccgtactaacttactacgtaccctacttcctagacccacaccgtcggacctacttaccacgtacgtaagttcggtaccggggg

SEQ ID NO: 143929 - DNA, 621 bp, Homo sapiens
  misc_feature: GYAE6OF01EW0GX.35.87.H10.1.454.CMB.1.raw
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgctattttaaaagtgtccagtgtgaggtgcacctggtggagtcggggcggaggcttcgttaagccgaggacgggtaccctaagactctcctgtgctagtttctggactttcccttnaatcgtccgccgtggatacgaacgtcgggtccgccaggcctccgaggggaacggctgggagtgggtcgcccganaagttaaaaggngtaattggagtcggacgggaacaacgacgacgtacgcttaccgacccgttcgacgggcagtacttccgaccgtctccgagacgtatgacttcatagatatcctatctacgtaacaatcgaacacgtccagaccgaaccgtacgacacgacgacgtacttatacctcgtaaccctacgtcctacgacctaaccgaccgtacggtacctaccgttaccaaacgacgttaacgttccgggtaaccgggggg

SEQ ID NO: 143930 - DNA, 689 bp, Homo sapiens
  misc_feature: GYAE6OF01DI1NP.35.87.H10.1.454.CMB.1.raw
  modified_base (353)..(353): a, c, t, g, unknown or other
  misc_feature (353)..(353): n is a, c, g, or t
  modified_base (471)..(471): a, c, t, g, unknown or other
  misc_feature (471)..(471): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctggagcgtggtagttttccttaggtgctaattttaaaagtgtccagtgtgaggtgcactggtggagtcgggcggaggtcttacgttaagccaggacggtccctaagctctcctgtgctagtttctggtacttcccttacatcgtcgcctggactgacgtggtccgcgaggctccggaagggagggactgggagtcgggttacnccgagtaagttaaaggagtaagttgagtagggaccggaacaaacgtacggactacggtccttacccgacccggttagacgggtctaagtaccgttccacccgtactaccgaagtacgnttacgaactttccgaagttgtaaccgtacttccgtacgttacctaactaacgtaatcgaacctagggtaccctaacggaaccgaaccggaagtacccaacgtaccggtaccttaacgtagttaccctacgaaccccttacgtactaaccgtaacccagttaccgaccgtaccttaccgtacggaaacgttaccgttaaggtcccggggtaaaccgggg

SEQ ID NO: 143931 - DNA, 630 bp, Homo sapiens
  misc_feature: GYAE6OF01A3XHP.35.87.H10.1.454.CMB.1.raw
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgctagtttctggtacttccctttacaatgtcgcctggatgaacgtgggtccncgaggcctccgaaggggaaggacgtggagtgggtcgcccgnaagtaaaaggngaattgagtggacggaacaacgagactacgcttaccacccgttcagggcaagtacttccaccgtctaccagagatgacttccatgatactcctgtcctactaacaaatnaaccncgtactacgaaccgaaccgagaaccacgtacgccgtaactacttaaccgtacgtaacccctacgtacctaccgaaccctaacctacgtaccggaccctaaccgttaccgaaacccggtaaccgttaacggtttcccgggtaacccggggggg

SEQ ID NO: 143932 - DNA, 582 bp, Homo sapiens
  misc_feature: GYAE6OF01BLT7O.35.87.H10.1.454.CMB.1.raw
  modified_base (286)..(286): a, c, t, g, unknown or other
  misc_feature (286)..(286): n is a, c, g, or t
  modified_base (347)..(347): a, c, t, g, unknown or other
  misc_feature (347)..(347): n is a, c, g, or t
  modified_base (465)..(465): a, c, t, g, unknown or other
  misc_feature (465)..(465): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtctggcggaggcttcgttaagccaggagggtccctaagacctctcctgtgctagtttctggtactttccctttnaatgtcgcctggatgaactgggtccgccaggctccgagggaggctggagtgggtcgcccgnaagttaaaaggagaagttgagtgggacggacaacgagactacgcttacgacccgttgagggctagacttccaccgtctccgagagatgacttccagtgagtattcctgtcctactaanaaactgaacacgcctagaaccaaccggaggaaccacgacgccgttactacttacctagtaccctacttctacgaacccactaccgtggacctacttaccaacgtacgtattccgggg

SEQ ID NO: 143933 - DNA, 577 bp, Homo sapiens
  misc_feature: GYAE6OF01CABLX.35.87.H10.1.454.CMB.1.raw
  modified_base (401)..(401): a, c, t, g, unknown or other
  misc_feature (401)..(401): n is a, c, g, or t
  modified_base (532)..(532): a, c, t, g, unknown or other
  misc_feature (532)..(532): n is a, c, g, or t
tcagtacagatcgtcacgaccggtgctcgatttagcagtactgcgttgggtttggggagctctgggagaggagccccagccttgggattcccaagtgttttcattcagtgatctggactgaacacaggggactcaccatggagtttgggctgagctggattttccttggtgctattttaaaagttgtccagtgtgaggtgcacctggtggagtcgggcggaggcttcgttaagccaggagggtccctaagactctcctgtgctagtttctggtattccctttcaatgtcgcctggatgaacgtgggtccgccaggctccgagggaggactggagtgggttcgcccgatagttaaaaggagaagttgagtggcggaacaacgagactacgcttcacccgttnacgggcagattcaccgtctccgagagatagacttccatgagtatctgtctactaacaatacgaacagcctagaaccaaccgagacacacgtcgtactacttactcgtacctacctcgtaccgacccactcncggactaccttaccgacgaacgtacttcggtcggggtaacccggg

SEQ ID NO: 143934 - DNA, 947 bp, Homo sapiens
  misc_feature: GYAE6OF01C3C9E.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctggagctggtattttccttggtgtctaattttaaaagttgtccagttgtgaggtgcaccgtggtgggaggtccggggcggaggtcgttcggttaacgccgagggacgggttacccctaaggaccttcctcccgtggtcgcgttacgttttcgttacggtaccttttccccttttacaaacgttcggttacccgtcccgttagggtaacttacggtaaaccggttcggggttaccccggacccgtaacgggtcccgttaaccccgggaaggggggaaacgggggttacccggtagggggtacggggttttcggggtttaccgggacccccggtaagttaaaacggtttaaaaaacggggaagggttaaaaggtttacgggtaaacggtttacgggggaacccggggtaaaccgaaaaccggtaacgggtaacccgttaaacccggttacccgtttaacccccggtaacccccgggttttacggaaaccgggggtaccttaaagggttaaaccctttccccggtaacccgttaccgttaccccgaaggtaccgtaagtcgtaactttacccgagtacggtacgttaccttccgtcgttacctaacgtaactaaacgttacgaaccgtaccgaccgttaacggaacccgtaacccggaggaaccaacgtaccggtacccgttagttaaccgttaaccgtacccgttaacctaccgtccgtacgaacccctacgtacccgtacggtacccgtaacgtttaccccggaagtaacccgttacgggttccggggtaaccggggg

SEQ ID NO: 143935 - DNA, 597 bp, Homo sapiens
  misc_feature: GYAE6OF01EECF4.35.87.H10.1.454.CMB.1.raw
  modified_base (349)..(349): a, c, t, g, unknown or other
  misc_feature (349)..(349): n is a, c, g, or t
  modified_base (381)..(381): a, c, t, g, unknown or other
  misc_feature (381)..(381): n is a, c, g, or t
  modified_base (550)..(550): a, c, t, g, unknown or other
  misc_feature (550)..(550): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattccctttcaatgtcgcctggatgaactgggtccgccaggctccgagggaagggacgtgggaggtgggttcgcccgnaagttaaaaggagtaattgagtggacgggaanaacgagactacgcttcgacccgttcgacgggcagtacgttccaccgtctaccagaacgattcgacttccaattcgaagtacttcccttgttcctactaacaaatagaacacgcctagaaccaaccggagaaccacacgcctactaacgttactacgtaccacttcctanacctcacctggacctacttaccaacgacgtaagttccggtacggggg

SEQ ID NO: 143936 - DNA, 601 bp, Homo sapiens
  misc_feature: GYAE6OF01BIE3V.35.87.H10.1.454.CMB.1.raw
  modified_base (285)..(285): a, c, t, g, unknown or other
  misc_feature (285)..(285): n is a, c, g, or t
  modified_base (367)..(367): a, c, t, g, unknown or other
  misc_feature (367)..(367): n is a, c, g, or t
  modified_base (438)..(438): a, c, t, g, unknown or other
  misc_feature (438)..(438): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgctagtttctggtactttccctttnaatgtcgcctggatgaacgtgggtccgccgaggcctccgaggggaaggctgggaggtgggttcgcccgataagttaaaaggngtaattgagtggacgggacaacgagactacgcttcacccgttcgacggcagtacttccaccgtctacaganactgattccatgagtatcctgtctactaacaaatgaacagtcctagaacaaccggagaaccacgacgcccgttacttaacttaccgtcgtaaccctacgtcctacgacccacgtaccgtcggacctaccttaccaaccgtaacgtaagttccggtacgggggg

SEQ ID NO: 143937 - DNA, 586 bp, Homo sapiens
  misc_feature: GYAE6OF01BGA2M.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcggggcggaggcttcgttaagccgaggagggtccctaagactctcctgtgcagtttctggactttccctttcaatgtcgcctggatgaactgggtccgccaggcctccgaggggaaggacgtgggaggtggggttcgccccggagaagttaaaaaggagtaagttggagtgggacgggaacaaacgacgaactacgccttcacccgttcgacgggcacgattccgaccgtctccagagatgattccatgagtctcctgtcctactacaatgaacagcctagaaccgaacgacgacacacgtccgtactacttacgtctaaccctactcctacgacccacaccgtgctacctacacgactagttcggacggggg

SEQ ID NO: 143938 - DNA, 647 bp, Homo sapiens
  misc_feature: GYAE6OF01BTJXS.35.87.H10.1.454.CMB.1.raw
  modified_base (346)..(346): a, c, t, g, unknown or other
  misc_feature (346)..(346): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttattttaaaagttgtccagtgtgaggtgcacctggtggagtcgggcggaggcttcgttaagccaggagggtccctaagactctcctgtgctagtttctggtattccctttcaatcgtcgcctggatgaactgggtccgccaggctccgaggggacggcgtgggagtgggtcnccgacagtaaaaggagtaatgatggacggacaacgacgactaccgcttaccgacccgttacgagggctagacttccaccgtctcccagagatagacttaccgatagacgtattccgttgtcccgttataaccgtaaatacgaaaccgacgaccgttagaaccgtaacccggaacggaactacccgaacgtcccggttaaccttaattaacccgttacgtaaccccgtactcccgttaccgaaccccgactacccgagtacccgtaccttacgaaccgtacgtaacgttcgtacccgggggg

SEQ ID NO: 143939 - DNA, 674 bp, Homo sapiens
  misc_feature: GYAE6OF01CWN2R.35.87.H10.1.454.CMB.1.raw
  modified_base (435)..(435): a, c, t, g, unknown or other
  misc_feature (435)..(435): n is a, c, g, or t
  modified_base (585)..(585): a, c, t, g, unknown or other
  misc_feature (585)..(585): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcacctggtggagtcgggcggaggcttcgttaagccgaggagggtccctaagactctcctgtgctagtttctggtacttccctttcaattcgtcgcctggatgaacgtgggtaccgccgaaggcctaccggaggggaacggacgtgggacggttcgggttacgccccgtataaagttaaaaaggagtaagttagagtacggacgggaacaacgagactacgcttacgacccgttnacgggcaagtacttccgaccgttcaccgaagacgtaatcgaactttccaagttacgaacgttactccgttgtacctactaacaaagtcgaaacctacgacccgtaacgaccgaaaccggaggaaccacgacgtcccgtaattacttaccnccgtaaccacgttcctaacgaaccctacgtaccgtcggaacccttaccgttacgaacccggtactaaacggttcccgggtaccgggggg

SEQ ID NO: 143940 - DNA, 647 bp, Homo sapiens
  misc_feature: GYAE6OF01C8EQ1.35.87.H10.1.454.CMB.1.raw
  modified_base (125)..(125): a, c, t, g, unknown or other
  misc_feature (125)..(125): n is a, c, g, or t
  modified_base (142)..(142): a, c, t, g, unknown or other
  misc_feature (142)..(142): n is a, c, g, or t
  modified_base (266)..(266): a, c, t, g, unknown or other
  misc_feature (266)..(266): n is a, c, g, or t
  modified_base (438)..(438): a, c, t, g, unknown or other
  misc_feature (438)..(438): n is a, c, g, or t
  modified_base (615)..(615): a, c, t, g, unknown or other
  misc_feature (615)..(615): n is a, c, g, or t
  modified_base (634)..(634): a, c, t, g, unknown or other
  misc_feature (634)..(634): n is a, c, g, or t
tcagtacagatcgtcacgaccggtgctcgatttagcagtactgcgttgggtttggggagctctgggagaggagccccagccttgggattcccaagtgttttcattcagtgatctggactgaacanagaggactcaccatggngtttgggctgagctggtattttccttggtgtacttaattttaaaagttcgtccagtgtagaggtgcaccgtggtggagtcgggcggaggcttcgtaagccgaggaggtcccaagactctcgtgngctagttctggactttccttacaagtcgtccgctaggatggaaacgtcgggtacccacgtagggccttacggaaggggtaacgggactgggacggttcgggttcgaccccgtataaaaggttaaaagggataagttgaacgtcgggaacgggaacaaacgagaccgttaacncgtacgaccccgttagagggctaaagtcttacgacccgtactaccgaagtacgtaattacggatttccgaaattggaacttactccgtagttactaccgtaaataaatacgaacgtacgcctaggaacctaacggcgaactacacggtctaacgtactacgataccactgacaccanacgcgactactcaacgtancgttcggaacggg

SEQ ID NO: 143941 - DNA, 720 bp, Homo sapiens
  misc_feature: GYAE6OF01E5Q8P.35.87.H10.1.454.CMB.1.raw
  modified_base (291)..(291): a, c, t, g, unknown or other
  misc_feature (291)..(291): n is a, c, g, or t
  modified_base (324)..(324): a, c, t, g, unknown or other
  misc_feature (324)..(324): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccagtggagttggggctgagcttggtattttccttggtgtcttaattttaaaagttgtccagtgtgaggtgcaccgtggtggaggtcgggcggaggtcttcgtaagccgaggaggtccctaagctctcctgtcgctagtttctggactttcccttnaattcgtccgccgtggatggaccgtcgggtccnccgaggcctaccgaggggacggcgtgggtaggttcgggttacacccgtagtaaagttaaaacggagtaagttggagtacgggacggaacaacgagtacctacgtcctaccgtacccgttgaacgggtcacgtcttacccgaccgtcgacccgaagtacgtaagttcgtaacttccgaagttgtaacgttaccttccgttagttacccgttaactaaccgtaaagttaccgaaaccgtacggtacccgtaacggaaaccccgaacccggaacggaaccctaacgtaccggttaccctaacttaccgtaccgttaccaacccttaccgtactaccgaaccctacgaccgtacgtaccctacttaccggaacgtaccggttacgtcggggtacccgggg

SEQ ID NO: 143942 - DNA, 759 bp, Homo sapiens
  misc_feature: GYAE6OF01CD5FB.35.87.H10.1.454.CMB.1.raw
tcagtacagatcgtcacgaccggtgctcgatttagcagtactgcgttgggtttggggagctctgggagaggagccccagccttgggattcccaagtgtttcattcagtgatctggactgaacacagaggactcaccatggagtttgggctgagtcttgggttttcctcgttgcttcttttaagaggtgtccagtgtcgaggtgcagcgtggtgcgaggtcgtgggggcgcgtggtccaggccgtggggacgtccctggacgacctctccgtgtcgaacgtcctcgtggtacttctcccttacgaaacggtaaccttagtcggtactaagttcgaccgtaccggttcgggtacccgcccgacgggtcctaccggaagggaccggaaagggggtccgtaggggtaagggttggggtggtaccgtaggttaggaattacgtacgttaagttttaggaagttaaggtaaaacgttaaaataaaaccttagttaaccgacgtaacggtaacccgtacggtaacgggtaaacgggtaccgtaacgttacccgaaccgtacgtaccctaaccgaagtaacgtaacctaaacgttaacccgaaaacaaccgtaccttacgttaccgtacctacgttacgacctaacgtaacgttacgaaacgtacgtacggtacggtaccgttagggaccggtaaccgtcggtaccttacggttacttacgttacggtcgtagtacggaagtaacgtaaataacggtaaatttacgg

SEQ ID NO: 143943 - DNA, 769 bp, Homo sapiens
  misc_feature: GYAE6OF01C5CQ0.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccgttggtgtcttaattttaaaagttgtccagtgtgaggtgcacgtggtggagtcgggcggaggcttcgtaagccagggacggtccctaagcctctcctgtgctagtttctggtactttccctttacaagttcgtcgtccttgggattagaaccgtgggtcccgaccgaggcctaccggaaggggaacggaacgtggggagtggggttcgaccccgtagtaaagtttaaaaaagggagtaaaacgttggaagttacggggaaccggggaaacaaaacgaaggtaacccgttacggtacctttacccgaaccccggtttacgacggggtacctaagggtacttacccgacccggtttacctacccgaaagtacggtaatacggtaacttacctaagtagtaacggttaacttccctaaggttcctaacttaaaccaaaagttcgaaacctaacgtacccgtaacgaaacccgaaaccggaacggaacctaactaaccgggtccctaacgttaacttaaccgtaccgtaaaccctactaccgtacaacccaacgccgtaggaccctaacgtaccaaacggtacgtaaacgttcgggtaaccgggggg

SEQ ID NO: 143944 - DNA, 719 bp, Homo sapiens
  misc_feature: GYAE6OF01C8C81.35.87.H10.1.454.CMB.1.raw
  modified_base (281)..(281): a, c, t, g, unknown or other
  misc_feature (281)..(281): n is a, c, g, or t
  modified_base (420)..(420): a, c, t, g, unknown or other
  misc_feature (420)..(420): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgtcttaattttaaaagttgtccagtgtgaggtgcaccgtggtggaggtcgggcggaggtcttacgttaacgccgaggacgggtccctaagactctcctgtgctagtttcnggtactttcccttacaacgttcgtcgcctaggtactaggtaacgtcgggtcccgcgtacggcctaccggaggggaacggcgtgggaggttgggtcgcccgataaggttaaaaggagtaagttggagtacgggacggaanaaacgcgaactacgccgttacacccggttgacgggctagtacttccgacctctccgaggatagtagtacttccgatcgtaagttactcgttcgtacctaacgtaactaaagcgtaaaccacgtaccctaagaacccgtaaacgacggaaccaacgtaccgaccttaacgtaacgtttaccgtaaccgttaaccccacgttaaccaccggtaacccctaccgtaacccggtccgtaacccgttaacccgttaaccgaaccggtaaacccgttaaggtttcccgggggtaaacccgggggg

SEQ ID NO: 143945 - DNA, 647 bp, Homo sapiens
  misc_feature: GYAE6OF01ASSAL.35.87.H10.1.454.CMB.1.raw
  modified_base (311)..(311): a, c, t, g, unknown or other
  misc_feature (311)..(311): n is a, c, g, or t
  modified_base (600)..(600): a, c, t, g, unknown or other
  misc_feature (600)..(600): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcggggcggaggcttcgttaagccagggagggtccctaagacctctcctgtgctagtttctggacttccctttcaatgtcgcctggatgaactgggtccnccgaggcctccgaggggacggactgggaggtcgggttcgcccgtagtaagttaaaaggagtaagttggagtgggacgggaacaaacgacggtaactaccggcttaccgaaccccggttacgacggggtccaaggtacttacccacccggttctacccggaagtagtacgtgtaactttccagtcgaagttctcccgttgtccttactaacaattcgaacagccctaagaaccgaaccgtaggaccacgagtccctactacttactcgtacccacgtcctacgaccctanaccgtcgacctaacttaccgaacgtaacgtacgttccggacgggggg

SEQ ID NO: 143946 - DNA, 788 bp, Homo sapiens
  misc_feature: GYAE6OF01AEFLV.35.87.H10.1.454.CMB.1.raw
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcaccgtggtgggagtcggggcggtaggtcttcggttaaggccagggacgggtccctaaggaccttcgtcctgtcgcctaggttttctggtacttccctttnaatcgtcgcctggatgacgtgggtccnccaggctccgaggggaacgggacgtgggaggtcgggttcgacccccggtagtaaggtttaaaaacgggacgtaaagttcggaacgttcgggaccggggtaaacaacggaacggtaccgtaaccggtccgtttaccgtaaccccgggtttcgaacggggtaccaacggttaccttacccgtacccgggttaccgtaacccgagggtaacgtaacgttcggtaaccttccgaagttccggttaagtacccgtttccgttacgttacccgttacctaaacgtaaacgttcggaaacccgtacgtcccgttaacggaacccgaaacccgggtacgaacccgtacgtacccgtacccgtactttacgtacgttacccgtaaccctaccgtccgttacaccccgtaactccgtacggacccttaaccctacgtaacccgacgtttaccggtcgggtaaccggggg

SEQ ID NO: 143947 - DNA, 694 bp, Homo sapiens
  misc_feature: GYAE6OF01C2AV3.35.87.H10.1.454.CMB.1.raw
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (394)..(394): a, c, t, g, unknown or other
  misc_feature (394)..(394): n is a, c, g, or t
tcagtacagatcgtcacgaccggtgctcgatttagcagtactgcgttgggtttggggagctctgggagaggagccccagccttgggattcccaagttgttttcattcagtgatctggactgaacacagaggactcaccatggagttgggctgagctggtattttccgttggtgtcttaatttttaaaagttgtccagttgtgaggttgcaccgtggtggaggtcggggcggaggtcgttcggttaagccgaggacggtccctaagctcctctgngctagtttcngtcttccttnagtgtcgctgatgacgtggccgcgnggctacgagggaggcgtgggagtggtcgcccgtagtaagttaaaggagtaagttagagtaggacggaacaaacgngacgtacgcttaccgaccgttacgacggctagtactccgacgtcacgagagtatcgtactcgagtacgtagttctcgttcgttactaacctaacgtaaagtacgaaccgtcgaacccgtaacggaacccgtaaaccgggacgaaacccgaacgacccgttacgttaacctaaccgtttacccggtacttaaacccccggtacttacccgaaccgtaacccctcccggacgttacccggaccttaaacccgttacccgaacccggttaaacggttaccggtacccggggtaacccgggggg

SEQ ID NO: 143948 - DNA, 709 bp, Homo sapiens
  misc_feature: GYAE6OF01DTN7J.35.87.H10.1.454.CMB.1.raw
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (401)..(401): a, c, t, g, unknown or other
  misc_feature (401)..(401): n is a, c, g, or t
  modified_base (490)..(490): a, c, t, g, unknown or other
  misc_feature (490)..(490): n is a, c, g, or t
  modified_base (534)..(534): a, c, t, g, unknown or other
  misc_feature (534)..(534): n is a, c, g, or t
  modified_base (572)..(572): a, c, t, g, unknown or other
  misc_feature (572)..(572): n is a, c, g, or t
  modified_base (662)..(662): a, c, t, g, unknown or other
  misc_feature (662)..(662): n is a, c, g, or t
tcagtacagatcgtcacgaccggtgctcgatttagcagtactgcgttgggtttggggagctctgggagaggagccccagccttgggattcccaagttgtttcattcagtgatctggactgaacacagaggactcaaccagtggagtttgggctgagctggtacttttccgttggtgtacttaagttttaaaagtgtccaggtgtggaggtgcgtacgtgggtggaggtcggggcggaggtcttacggtaagccgaagggtacggtcctaagcctntcctgngcgtagttcgtgtacttcccttgaatcgtcgcgtgtagtagtaccgtcgggtccgcgaacggtccgaccggaaggggaacgcgtacggaggtcggtacgaccgacgtaaaggttaaaggngtaagttggaagtccggaagggtaacaacgacgaaccgtaccgtcgttaaccgacgttacgaggtaccagttacttaccgacccgttanccgaaggatacgtcgtaactaccgtaggtaatagtacttccgtnttacctaaactactaaaagtcgaaacgacgtacccganaaaccggacccgaaggtacctaacggaccgtacttaacggttattaacggacccgttaacacccggtactaccgaaccaaacgccggttnaacccgtacgttaacgaaccggtactaacggttccgggtaaccgggg

SEQ ID NO: 143949 - DNA, 816 bp, Homo sapiens
  misc_feature: GYAE6OF01DKRP4.35.87.H10.1.454.CMB.1.raw
  modified_base (220)..(220): a, c, t, g, unknown or other
  misc_feature (220)..(220): n is a, c, g, or t
  modified_base (285)..(285): a, c, t, g, unknown or other
  misc_feature (285)..(285): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttattttaaaagttgtccagtgtgaggtgcacgtggtggagtcgggnggaggcttcgtaagccaggagggtccctaagcctctcctgtgctagttctggtactttccctttnaaccccttgtaccgtcctgggtatcggtaacgtcggggtccccgccgaacgggtccttacccggaagggggaacggggtaccgtggggtagggttcgggggtttccggacccccggtaagtaaaaggtttaaaaacgggaagtaaacgttttaggaacggttcggggaaccgggaaaccaaaacgacggtaaccttaacggtaccgttaccgtaacccccgggtttcgaacggggtacctaacggtaactttacccgacccgttaccgtacccgaggtaagtacgtacggtactttcccgaaagttggtaaacgttaccttccgtttacggttacctaccttaacctaaaagttacgaaaaccgtacggaccccgttaaggaaacccgaaacccgggtacggaacccaacgtaccggaccccttacgtttaaaccttaaccgtaccgttaaacccaccgttacgtaccgaaccctacgacctcggacctaccttaacgaaccggtaacgtacgtttccgggaaccgggggg

SEQ ID NO: 143950 - DNA, 594 bp, Homo sapiens
  misc_feature: GYAE6OF01ANOOS.35.87.H10.1.454.CMB.1.raw
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (370)..(370): a, c, t, g, unknown or other
  misc_feature (370)..(370): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (549)..(549): a, c, t, g, unknown or other
  misc_feature (549)..(549): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttaattttaaaagttgtccagtgtgaggtgcactggtggagtcgggcggagtcttcgtaagccaggacgggtccctaagctctcctgtgctagtttcnggtacttcccgtttnaatcgtcgcctaggactgaacgtgggtccncgaggcctccgagggaggtcgtggaggtcgggtcgcccgataacgttaaaaggntaagttgagtcggacggaacaacgagactacgcttacacccgttgaggcagcttaccaccgtctcgagcgatgtaactcatgagtactccgtagtctactaanaactnaaaccncgcctagaaccaaccggtagaaccacgacgtcctacctatacctgtaccctactctacgaacccncgtacgtccgactactaccaaccgtagtacgttcgggtaacgggg

SEQ ID NO: 143951 - DNA, 759 bp, Homo sapiens
  misc_feature: GYAE6OF01CF05A.35.87.H10.1.454.CMB.1.raw
  modified_base (221)..(221): a, c, t, g, unknown or other
  misc_feature (221)..(221): n is a, c, g, or t
  modified_base (292)..(292): a, c, t, g, unknown or other
  misc_feature (292)..(292): n is a, c, g, or t
  modified_base (375)..(375): a, c, t, g, unknown or other
  misc_feature (375)..(375): n is a, c, g, or t
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggattttccttggtgcttattttaaaagttgtccagtgtgaggtgcaccgtggtggagtcgggnggaggcttcgttaagccgagggagggtaccctaagacctctcctgtgctagtttctggtactttccctttnaatgtcgcctggatgaactgggtccgcaggctccgaggggaacggcgtgggtaggtgggttcgcccgtagaagttaaaacggngtaagttgagtcggacgggaaacaacgaacgtactacgccttaccgacccggttacgagggtacaacgttacgttacccgacccggttcctcccgaaacggtacgtaagttacgtaacgttcccgtaagttacggtacgttaacgttcccgttacgttaccccttaacgttaaaccgtaaaacgttacgtaaaaccgtacgtaccccgtaacggaaaaccccgtaaaccggaaccgggaaccgtaaccgacggttaaccccgttacttaaacgttacccgttaccgttaaccctacccgttcctaaccgaaccctaaccgtacgtaccggtacctaaccgttacccaacggtaaccgttaaccggttcgggtaaacccgggggg

SEQ ID NO: 143952 - DNA, 854 bp, Homo sapiens
  misc_feature: GYAE6OF01A8KLR.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttaattttaaaagttgtccagtgtgaggtgcacctggtggagtcggggcggaggtctttacgttaagccgagggacgggtcccctaaaggacctctcctgtcgcagttttctggtacttccctttcaacgttgtccgtccgtggtactggtaaaccgttcggggtcccgtcccgaagggccttcccggaagggggtaaggggaccgtaggggaacgggttggggttccggaccccggtacgtaaacggtttaaaaaaggggacgtaaaagtttcggaaacgttggggaacggggtaaaccaaacggaaacggtaaccgtaaccggtccttacccgtaaccccgggtttacgaacggggtaccgaacggtaactttcccggaaacccgttcctaacccgaacggtaggtaacgttacggtaaactttaccgaacgttaggtaaccgttaacgttaccccttaggttacccttaaccgttaaaccgtaaaacttacggaaaccttaacgtaaccgtacggtaaacccgaaacccggaaggtaaacccaaccgtaccggtaccgttaccttaaccgttaacgttccgtaaacccgtaaccgttacctaccgtaacccgtacctaccgtacggaccctaaccttaccgaaaccgtacggttaaccgttcgggtaacccggggggg

SEQ ID NO: 143953 - DNA, 798 bp, Homo sapiens
  misc_feature: GYAE6OF01B1PT6.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcaccgtggtggagtcgggcggaggcttcggttaagccgagggacggtccctaagactctcctgtgctagtttctggtactttccctttacaaattcgtcgtcccgtggattggaaccgttggggtccccgaccgacgggtcctaccggagggggaacgggtaccgtggggaggttggggttaccgccccggacgtaaagtttaaaaagggagtaaacgtttggaggtgggaccgggaacaaacgaacggtacctaaccgtccttaccgtaccccggttacgaacggggacctaacggtactttccgaacccgttcgtacccgaaggtaacgtacgttacggaactttcccgaagttaccggtaagttacgttacccttcggttaccctttaaccgtaaacctaaagtacgaaacctacggtcccgtaagaaacccggaaccgtaaggaacccaacgaccggtaccgttaaccgttacgttaaccgttaccgttaaacccctacgttacctaccgaaaccctaccgtacccggtacggaccccttaccgtttaccgaaacccggtaaccgttaacgttccggggtaaccccggggggg

SEQ ID NO: 143954 - DNA, 744 bp, Homo sapiens
  misc_feature: GYAE6OF01AVK6J.35.87.H10.1.454.CMB.1.raw
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgtcttaattttaaaagttgtccagtgtgaggtgcaccgtggtggaggtcgggcggaggcttacgttaagccgaggtacgggtccctaagactctcctgtcgctagtttctggactttcccctttanaacgtgtccgtccgtaggtatacggaacgtcgggtcccnccgaggccgtccggaaggggaggtacgtgggacgtgggttcgaccccgagtaaagttaaacgggataagttgacgtggacggaacaacgacgactacgtcttacccgacccggttcgacgggtacacggtactttacccgacccgttctacccgaagagtacgttacgaacttaccgaagtacggtacgttaccgttccttagtaccctacctaaactaaacgttacgaaaacctcggtaaccctaacggaaaccccgaaacccgggtaacggaaccaacggtaaccgtacccgttactaacgttaccgtaccgtaaccctacgtccgttaacgaaccccgtacacccggttagaacccttacgttacccgaaagtacccgttaaacggttccgggtaaaccgggggg

SEQ ID NO: 143955 - DNA, 686 bp, Homo sapiens
  misc_feature: GYAE6OF01A4PGJ.35.87.H10.1.454.CMB.1.raw
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccagtggagtttgggctggagcgtggtatttttccgttgggtgtacttaagtttttaaaagttgtccgtaggttgtggaggttgccaccgtggtgggaggtccggggcggaggtcttacggttaacgccgaagggacgggtaccctaaggactcctccgtgtgctagtttcnggtacttccttanatcgtcgctggatgacgtggccncgaggctcggagggacggtctgggaggtcgggtcgcccgagtaagttaaaaggagtaagttggacggtggaacgggtaacaaacgagtacgtacgtaccttccgacccgttagagggctaagtctaccgaccgtctccgagtacgatcgacttacgagtgtagtactccgttacgtcttactaacgtaacgtacgaaaccgtacgtacccgaacggtaaccgaacccggtaggaacccaacggtaccgtacccgttaacttaccgttaccgtacgtaacccagtccgtaccgacctacgtacgcgtacctaccgtacaacggtactaccggttgggtaccggg

SEQ ID NO: 143956 - DNA, 734 bp, Homo sapiens
  misc_feature: GYAE6OF01D68I8.35.87.H10.1.454.CMB.1.raw
  modified_base (223)..(223): a, c, t, g, unknown or other
  misc_feature (223)..(223): n is a, c, g, or t
tcagtacagatcgtcacgaccggtgctcgatttagcagtactgcgttgggtttggggagctctgggagaggagcccccagccttgggattcccaagtgttttcattcagtgatctggactgaacacagaagactcaccatggagtttgggctgagctggtattttccgttggtgtcttaattttaaagttgtccagtgtgaggtgcacgtggtggagtcgggnggaggtcttacgtaagccgagggacggtaccctaagacctcctccgtgtcgtctagtttctggtactttcccttataatcgtcgtccgtggtatcgaacgtcgggtcccgcgacggccgtaccggaaggggtaacgggtacggtgggtacggttcgggttccgacccgtagtaaacgttaaaaggaagtaagttaggagtcgggaccggaaacgaacgtacggaccgtaccgtccttacccgacccggttcgacgggtaccaggtacttccgtacccgtctaccgagtacgtatacgttactaccgtagtagtaacgttacgttccttcgttacctacgtaactaaacgtacgtaacgtacgtccgtaacggaaccgaaccggaacgacctaaccgacgtaccggtaacttaaccgttacgttaccgtaccctaccgtccgtaccgaaccctaccgtacgtaccgtacctaccgtacgaaccggtaacggtacgttccggggtaccggggg

SEQ ID NO: 143957 - DNA, 774 bp, Homo sapiens
  misc_feature: GYAE6OF01AMVWY.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttattttaaaagttgtccagtgtgaggtgcaccgtggtggaggtcgggcggaggtcttcggttaagccgagggacgggtccctaagactctcctgtcgctagtttctggtacttccctttcaatcgtccgcctggtactgaacgtcgggtacccgccgaggccgtacccgaggggaacgggacgtggggaaggttcggggttcgaccccggtagtaaacgttaaaagggagtaagttggaagtcgggacgggtaacaacgaaggacctacgtccttaccgtaccccggttcgaacggggtccaaggtactttacccgaacccggttcctacccgaaggacgtagttacgtaacttacccgatacggtaacgttacttcccgttaggttcccttacttaaacctaaacgttacgaaacctaacgcccgttaacgaaccgtaaacccgggaaggtaacccaaccgtaccggtacccgttacgttaacgtttacccgtacggttaacccctaccgtttaccctaccgaaccctaaccgtaccgttaccggacctaaccgttacccgaaccggtaaccgtaacgtttccggggtaacccgggggg

SEQ ID NO: 143958 - DNA, 844 bp, Homo sapiens
  misc_feature: GYAE6OF01B8IHM.35.87.H10.1.454.CMB.1.raw
  modified_base (298)..(298): a, c, t, g, unknown or other
  misc_feature (298)..(298): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagtctggtattttccgttggtgtcttaagttttaaaagttcgtaccagtgtgaggtgcaccgtggtggagtcgggcgaggtcttacggtaagccgaggacggtaccctaagcctctctgtcgctagtttctggtacttccctttanaatcgtccgcctggatacggaacgtcgggtccgccgacggtccgtaccggagggaacgggtcgtgggaggttcgggtcggacccgtagtaaacgttaaaagggagtaacgttaggaagttacgggacgggtaacaaacgacgtaacgtaccgtccttaccgacccgttgaacgggctaaggtactttacccgaccgttcctaccgaaaggacgtactcggttaacttccgaagttacggtaacgtttaccgttccgttcggtacctttaaccgttaaacgtaaacgttaccgaaaccgtacggttacccgttaaccggaaacccgtaaacccgggaacggtaaaccctaaccggtacccggttacccggtttaacctttaaaccggtttaccgttaaaccccggtaaacccctttacccgttacccgtaaacccggaaccccttaaacccggacccgtttacgggtaaccccttaacccggtttaacccgaaacccgggttaaacccggttaaaccgggtttcccgggggttaaaccccggggggg

SEQ ID NO: 143959 - DNA, 869 bp, Homo sapiens
  misc_feature: GYAE6OF01C5VTH.35.87.H10.1.454.CMB.1.raw
  modified_base (220)..(220): a, c, t, g, unknown or other
  misc_feature (220)..(220): n is a, c, g, or t
tcagtacagatcgtcacgaccggtgctcgatttagcagtactgcgttgggtttggggagctctgggagaggacgccccagccttgggattcccaagttgttttcattcagtgatctggactgaacacgagaggactcaccagtggtagtttggctgagtctggtattttccgttggtgtacttaagtttttaaaagttcgtacctaggtgtaggaggtcncgtaccgtgggtggaggtccgggacggaggtccgttacggttaacggccgaagggtacggtcccgtaaagccttcgttccgtggtcgacgttacgttttccgtggtaaccttttccccgttagtaacgtcgtcccggtccgttaggaacgtaggtaaacggtttccggggtacccaccggtaacggtccgtacccggaaagggggtaacggacgttagggtacggtttccgggttacgccccgtaagtaaaacggtttaaaaagggagtaaaggttggtaacggtacgggaacccggtaaaagaaaccgtaaacggtacccgttaaaccggccgttaacccggtacccggtttacgaacggggtactaaaccggtacttacccgaacccggttacgacccgaagtacgtacgtaacgtacgttacccaagttacgaaacgttacgttacccttacgttaacgtaccgttaaaactaaacgtaacgtaaccgaacgtaaccgtaacgaccgtaaacccgaagtaaccgaacgacgtacccgttaattaccttaaccgtaccgtaacccgccgttacaacccgaccctaaccgtaccgtacggtacctaaccgttacaacggttaaccggttaacgtcgggtaacccgggg

SEQ ID NO: 143960 - DNA, 731 bp, Homo sapiens
  misc_feature: GYAE6OF01BNGOU.35.87.H10.1.454.CMB.1.raw
  modified_base (212)..(212): a, c, t, g, unknown or other
  misc_feature (212)..(212): n is a, c, g, or t
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggtattttccttggtgtcttattttaaaagttgtccagtgtgaggtgcacctggnggagtcgggcggagtcttcgttaagccagggacgggtaccctaagactctcctgtgctagtttctgtacttccctttcaatgtcgctggatgacgtcggtccgcaggctcgagggaaggcgtggagtggtcgccgataacgttaaaggataattgagtggacggaacaacgagacgtacgtcttcgacccggttcaagggtcaacgtacgtttacgacccgttctacgtacggaagtacgtgtaacttccaagtacgtaaggttaaccttccttaggttaccttacttaaacgaaatacggtaaacctaacggcccgtaaacggaaccgaaaacccgggacggtaaaccgtaaccgacggtaccccgtttacttaaacgtttaccccttagggtttaaccccctaacgttcccgttaacggaaacccccaacttacccggtacggttaaccctaacccgtttacccgaaaacccggttaaccgggttaaacgttcccggggttaaaccccggggggggg

SEQ ID NO: 143961 - DNA, 824 bp, Homo sapiens
  misc_feature: GYAE6OF01CLM2Z.35.87.H10.1.454.CMB.1.raw
tcagtacagatcgtcacgaccggtgctcgatttagcagtactgcgttgggtttggggagctctgggagaggagcccagccttgggattcccaagtgtttcattcagtgatctggactgaacacagaggactcaccatggagtttgggctgagcgtggtattttccgttggtgtacttatttttaaaaagttcgtccgtagtggtgaggtgccgtaccgtgggtggaggtcgggcggagtcgttacgtaagccgaggacggtccctaagacctctccgtgtcgctacgttctggtactttcccttagtaagttcgtccgccttaggtagttacgaaccgttcgggtacccgaccggtacggcccgtaaccggaacggggaacgggtacgtgggtacggtttcggggttccgaaccccggtaacgttaaaaggttaaaaagggaacggtaaagttacggaaggttacgggaaccgggaacgtaaacgaacggtaaccgttaacgtacccgttaaccgtacccggttaccgaagggtccaaggttacctacccgtaccgttacctacccgaggaacgtacgtacgtaacttacccgaagttaccgtaagtttcctaccgtttacgtccctaaagttacctaaaagtcggtaaaacctacggtaccgtaaccgaacccgaaaccggtacggaaccctaacgcccggttacccttacggttaaccttcccgaaacgtttacccaccttaaccggtaccgaccctaacctccggtaaccgcccttaaccggtaaccaccggttaaacgtcgggttcggtaacccgggggg

SEQ ID NO: 143962 - DNA, 675 bp, Homo sapiens
  misc_feature: GYAE6OF01E5JM2.35.87.H10.1.454.CMB.1.raw
  modified_base (320)..(320): a, c, t, g, unknown or other
  misc_feature (320)..(320): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcaccgtggtggaggtcggggcggaggcttcgttaagccgaggacgggtccctaaggactctcccgtgtgctagtttcgtggctttccttacaatcgtcgcctggatcgaacgtcggtccnccgaggcctaccgaggggaacggcgtgggaggtcgggtcgcccgtacgtaaagttaaaaggagtaagttgacggtacggaccgggaaactaacgaacgtaaccgtaccgtccgttaccgacccggttacgacgggactagtaccttaccgacccggttcaccgagaagtatacggtacttacgagtagtacgttactccttagccttaccaataagtacgaactacgcctaacggaacctaaccgggaacgacaacgtcggtaccttacttaacgttacaccgtaacctacgttcgtaccaacctacgtacgcgtacctaccgacgaaccgtacgttagtcccgggtaacggggg

SEQ ID NO: 143963 - DNA, 734 bp, Homo sapiens
  misc_feature: GYAE6OF01C4J7J.35.87.H10.1.454.CMB.1.raw
  modified_base (291)..(291): a, c, t, g, unknown or other
  misc_feature (291)..(291): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgctattttaaaagttgtccagtgtgaggtgcaccgtggtggaggtcgggcggaggtcttcgttaagccgaggacggtccctaagacctctcctgtgctagtttctggtactttccctttnaatcgtccgcctaggatgaacgtcgggtcccacgaggcctccggaaggggtaacgggcgtgggaggttcgggttcgccccggtagtaaagttaaaacggagtaacgttggaacgtcgggacgggaacaacgacgacgtacgtcttccgaacccgttcgacgggtacagtacttccaccgtctccgaagtacgattacgtactttaccgaagttacggtacgttacgttacccgttcgttaccttacgttaaaccaaacgtttacgaaacctacggtacccgtaacggaaacccgaaccgggtaacggaaccaaccggtaacgtaccccgttaacttaaacgtttaccgtacgtaaccccttacgtacccttacgaaccctaccgtaccgtacggtaccctacgttacccgaacggtaacgtacgttccggggtaacccggggg

SEQ ID NO: 143964 - DNA, 947 bp, Homo sapiens
  misc_feature: GYAE6OF01CHWM6.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccgttggtgacttaattttaaaagttgtccagtgtggaggtgcaccgtgggtggaggtcggggcggaggcttcggttaacgccgagggacgggtaccctaagacctctccgtgtcgctagtttctggtactttccctttacaatcgtaccgccgttggatcggaacgttcggggccccgccgacgggtcctacccggaagggggaaacggggaccgtggggtaacgggttcggggttcggacccccggagtaaacggtttaaaaagggacgtaaagttaggaggttcgggacggggaaaccaaacggaacggtaaccttaaccggtcccgtttaccgtaacccccgggtttcgaaccgggggtcctaaacggtaccgtttacccgaaccccgttccctaacccggtaaggtacgggtaacttacggtaaccctttaccgtaacgttacggttaacggtttaccttacccggtttacggttaaccctttacccgtaaaacgttaaactaacggtaaaaccccgtaacggtacccgtaaccgaaaccccggtaaaaccgggtaaccgggaaccctaaccggtaaccggtaccccgtttaaccgttaacgtttaaacccgtaccgttaaaccccgtaacccgtttacccggtaaccccgtaaaccccgtaaacccgtttcccggtaaacccgggttaacccccttaaacccggtttaacccggaaaccccggtaaaccgggtttaaacccggggtttcccgggggtaaaaccccccgggggggggg

SEQ ID NO: 143965 - DNA, 743 bp, Homo sapiens
  misc_feature: GYAE6OF01DITT0.35.87.H10.1.454.CMB.1.raw
tcagtacagatcgtcacgaccggtgctcgatttagcagtactgcgttgggtttggggagctctgggagagggagccccagccttgggattcccaagtgttttcattcagtgatctggactgaacacagaggactcaccatgggagtttgggctgagctggtattttccgttggtgtacttattttaaaagttgtccaggttgtgagggttgcctaccgtgggtgggaggtccggggcgggacggtctttacggttaacggcccgtaagggtacggggttacccctaaaggaccttcctccgttgtcgtcttagtttctggtactttccctttacaattcgcgtcctggatgaacgtcgggtccgcgaggcctaccggagggagggacgtggagggtgggtcgacccgtagaaagttaaaggataagttagagtagggacggaacaaacgacgtaactaccgtcttaccgaacccgttcggacgggtctagtacttccgaccgttaccaccgagagtacgtagtacttaccaatcgacttactcgttcgtactactaacgtaatagaacctaggaccctaggaaaccctaaccggggagaaacccacgtacgtacccgttaacgtaacctttacgacccgttaaccctccggttaccctaacccgtaccctaaccgttaccgtacgaccttacccggttaacaccggtaaaccccggttaggttcccggggtaacccggggggg

SEQ ID NO: 143966 - DNA, 739 bp, Homo sapiens
  misc_feature: GYAE6OF01AMMBN.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtcgcacctggtggagtcggggcggaggcttcggttaacgccgagggacgggtccctaagacctctccgtgtgctagtttctggtacttccctttcaattcgtcgcctggatcggaacgtcgggtccgaccgacggtccgtaccggaaggggtaagggaccgtcgggaagggttcggggttacggccccggtacgaaacggtttaaaaaggacgtaaagttgggaacgttacgggaccgggtaacaaacgaacggtacctaccgtccgttaccgtaaccccggttcgaacgggtcaacggtacgttcctacccggtctcccgaagacgtacgttagtaacctttaccgagttacgtaacgttacttcccgttagttacccttaacgtaactaaacgtctaaaccgacgtacctacggaaccgtaaccggacgaaccacgtacggacccttacgttacttaccgtaccgtaacctacgttccaccaaccgcaaccgtcgacctaacttaccgaaccgtaccgtaggttcccgggtacggggg

SEQ ID NO: 143967 - DNA, 916 bp, Homo sapiens
  misc_feature: GYAE6OF01E2KDW.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagttggggctgagctggattttccttggtgctattttaaaagttgtccagtgtgaggtgcacctggtggagtcgggcggaggcttcgttaagccaggaggtccctaagactctcctgtgcagtttctggattccctttcaatgtcgtcctggacttaggaaccgtggggtccccgacccgtagggccgttcccgaagggggaaacggggaccgttaggggaggttacgggggtttcggaccccccggtacgtaaacgttttaaaaaaaggggacggtaaaagtttcggaacggtttacggggaccggggtaaacgaaacggtaacggaaacccgtttaaccgggtaccttttacccggaacccccggttttaccggaaccgggggtcctaagggtaaccttttacccggaaccccggtttccgtaccccgaaagggtaaccggtaatttacgggaaacttttcccgaaatttcgggaacggttttaactcccggtttacggttaccttaccccgttaaacgtaaaaacttcggtaaaaccgaacggtcccctttaacgggaaaccccggtaaaaccccggacgggtaaacccaaccgtaaccgggtaccccggttacctttaaacgttacccgtttaccggttaaacccccgtaaccgttttacccgtaacccggtaacccctaacccgtaaccgttcccgggtaacccttaacccgttttaccccggaaacccgtaaccgggtaaaccgttttcggggtaaccccggggggggg

SEQ ID NO: 143968 - DNA, 690 bp, Homo sapiens
  misc_feature: GYAE6OF01B2KB7.35.87.H10.1.454.CMB.1.raw
tcagtacagatcgtcacgaccggtgctcgatttagcagtactgcgttgggtttggggagctctgggagaggagccccagccttgggattcccaagtgtttcattcagtgatctggactgaacacagaggactcaccatggagtttgggctgagctggtattttccgttggtgtacttaattttaaaagttcgtcctagtgtggtaggtgcaccgtgggtggaggtcgggcggaggtcttacgtaagccgaggacggtccctaagacctcgtcctgtgctagtttcgtgtacttccttacagtcgtcgcctggatcggtaacgtcggtccgccgaggtccgtccggaaggggaacgggacgtgggtacggtgggtccgaccgtaacgtaaaggtaaaaggagtaattggagtcgggacggaacaaacgacggacctacggtaccttaccgacccggttacgacggtactacggtactccgaccgtctaccgaggacgtagtactacgtacagtacggtagttcctcgtacgtactactaagtaaactcgaaactacgccgtaacgaacccgaacggaaccgaccacgaccgtaccgttactaccttacgtccctaaccgtacctacgtaccaacccgtacacgttacggccctaagtaccaacgtaccgtaacggtcgggtaacccggggg

SEQ ID NO: 143969 - DNA, 806 bp, Homo sapiens
  misc_feature: GYAE6OF01BEMHL.35.87.H10.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (632)..(632): a, c, t, g, unknown or other
  misc_feature (632)..(632): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccgttggtgcttaattttaaaagttgtcagtgtgaggtnctaccgtggtggaggtcggggcggaggtctttcggtaagccgagggtacggtaccctaagaccttcctccgtgtcgctagttctggtactttcccctttanaagttcgtcgtcctggaactcgaacgtgggccccgccgaacggccgtaccggaaggggaacgggtacgtaggggacggttcggggttaccgaccccggtacgtaaagttaaaaacggagttaaagttggaacggtacgggaacggggtaaccaaacggtaaccggtaacctaacccggttaccttacccgtaaccccggtttacggaacggggtacctaacggtaccttacccggtaacccgttccgtacccggtaaggaagtactacggtaaccgttacccgaagtacggtacgttaactccgttcgttacctacttaaacgtaaanaccggtaaacctacgacccgtaacgaacccggtaaccgtaaacggaacccaaccggtacccgtaccgttaccgttaaaccttaccgttacctaacccgtacctacgtacgtaaccccaccgtaccgtacgaccctaccgttacaccgtaacgtacgttccgggtaacccggggg

SEQ ID NO: 143970 - DNA, 973 bp, Homo sapiens
  misc_feature: GYAE6OF01DPEA2.35.87.H10.1.454.CMB.1.raw
tcagtacagatcgtcacgaccggtgctcgatttagcagtactgcgttgggtttggggagctctgggagaggagccccagccttgggattcccaagttgttttcattcagtgatctggactgaacacagaggactcaccatggagtttgggctgagcgtggtattttccgttggtgtacttaatttttaaaagttcgtaccgtagtgtgaggtgacctaccgtggtggaggtcggggcggacggtcttacggttaagccgagggtacggtaccctaagacctccgtaccgtgtcgcttacgtttcgttacggttaccttttaccccgtttacgaacgtttcggttcccgtaccgttagggtaacgttacggtaaccggtttccggggtccccgtacccgtaacgggtacccgttacccgggaacggggggtaaacgggtacggttacggggtaagggtttcggggtttacccgaccccggtaacgtaaaaggtttaaaaacgggagttaaacgtttagggaacggttacgggaacccgggtaaactaaacccggtaaacggtaacccgttaaccggtacccgtttacccggtaaccccggtttacgggaaaccgggtaccgtaacgttaccgtttacccgtacccggttaccctaccgaaaggtaccgttaagtttaccggtaacctttacccgaaggttacggttaactttaccgttacccgtttagtaaaccttaccgttaaaactaacgtacgtaaacccgtacggttcccgtaaacggaacccgaaacggtaccggaaacctacgtaaccggttacccttaacttttaacccggtaaccgttaacgtaaccccccgtaagtttaacccctaccggaaaccccttacggtaaccgttcggtaaccccttaaaccgtaacccggaacccggttttaaaaccgaccgggtttccgggggtaaccccggggggg

SEQ ID NO: 143971 - DNA, 776 bp, Homo sapiens
  misc_feature: GYAE6OF01CC31B.35.87.H10.1.454.CMB.1.raw
tcagtacagatcgtcacgaccggtgctcgatttagcagtactgcgttgggtttggggagctctgggagaggagccccagccgttgggattcccaagttgttttcattcagtgatctggactgaacacagaggactcaccatggtagtttgggctgagtcgtggtatttttccgttggtgtcttaagtttttaaaaaggtgtaccgaggttgtggaggtgcagcgtgttggaggtcggtgggggtaggtcgttggtacgaggtccggttcgggggtcccctggacgtacgtccgtccgtggtacgaacgtcccttcgttaggtactttaccttaaccgtttaaggaaccttagtcgtacctattggtcgtccggttcggggtccccgaccggtacggcccgttaccgggaagggggtaacggggtcggtagggtaggttcgggtacgtgtaaggtttagttaggtgggttagtggtagtaacttacgtaataactactacgacgacgtaccgtccggtacgggacgggtcccgttacacccgtagtaccctaccgaacgtaacgtaacttaaccgtaaacaaacgtaaccaacgtaccgtaaagaaccttcgaacggaaccaaagtacgaactaggaccgtggaaaccggacgggtaccggaacggtacccggtaacgtaaccggttattaaccgttcgtaacgtacgggaaataacggaactaggtaaccttacggttaattaacgttacgagtttaccgtaggttaacggtaaaa

SEQ ID NO: 143972 - DNA, 765 bp, Homo sapiens
  misc_feature: GYAE6OF01EG1Z6.35.87.H10.1.454.CMB.1.raw
  modified_base (303)..(303): a, c, t, g, unknown or other
  misc_feature (303)..(303): n is a, c, g, or t
tcagtacagatcgtcacgaccggtgctcgatttagcagtactgcgttgggtttggggagctctgggagaggagccccagccttgggattcccaagttgttttcattcagtgatctggactgaacacagaggactcaccagtggagtttggctgagcgtggtattttccgtggtgtacttaattttaaagtgtccagtgtgaggtgcgtacgtggtggacggtcgggcggaggtcgtttacgtaagccgagggtacggtaccctaagcctcgtccgtgtacgcgtagttctgtacttcccttanacttcgtccgtcgtgatcggtaacggttcggtacccgcgacgggccgtaccgggaaggggtaacggcggtcggggtaggttcgggttacgaccccgtagtaaacgttaaaggagtaacgttaggaggtacgggacggaacaacggtacgtacgtacccgttcgttacccgaccgttacggacggtactacggtaccttacccggtacccgtaccgtaccgacggtaacgtacgtacgttaccttacgagttacgtacgttccgtaccgttacgtacctacgtaaacgttacgaaccgtaaccacggtaccaacgaaacccggtaccgtaacgtaccgaacgtccggtaactttaccctacgttaaccgttacctacccgtacgtacccgtacgtaaccctacgtacccgtaccgtactaacccgttacgaaccggtttacgtacggtccggggtaacccggg

SEQ ID NO: 143973 - DNA, 919 bp, Homo sapiens
  misc_feature: GYAE6OF01CQHGY.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtatttttccgtggtgtctatttttaaaagttgtccagtgtgagtgcaccgtggtggaggtcgggcggaggtcgttcgttaagccgaaggacggtccctaagacctctcctgtgtccgtagtttctggtactttccctttactaacgttcgtcgtccgttaggtacgtaggtaaaccgtcggggtaccccgcccgtacgggtcctaaccccggagggggtaaacggggtaccggtacgggtaaggggtttcggggtttaccggaccccggttaacggtaaaacggtttaaaaagggaaggttaaagtttacgggtaacggttacggggtaaccggggaaaccgaaacggtaaacggaaacccgtttaacggtaccccgttacccgttaacccccggggttcgtaacggggtaccgtaaccggtaaccgtttaccccgaaccccggttacccgttaccggtaaccggtaacggtacttacgggtacttaaccgtacggttaacgtaacggtttaccgttacccgtttccggtaccttaaccgttaaactaaacgtaacgtaaaccgttacgacccttaacggaaacccgtaaaccgggaacgtaacccgaaccgtaacgttacccgttaacgttaaccgtttaacccgtaccggttaaccctaaccgttacccgtaaccaacccgttacccgtaaccgtacccgtacgttacccgtttaacgaacccggttaacggttaggttacccggggtaaccccggggg

SEQ ID NO: 143974 - DNA, 661 bp, Homo sapiens
  misc_feature: GYAE6OF01CIT80.35.87.H10.1.454.CMB.1.raw
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgtcttattttaaaagttgtccagtgtgaggtgcaccgtggtggagtcgggcggaggcttcgttaagccaggagggtccctaagctctcctgtgctagttctggtactttccctttcaattgtcgcctggatgaactgggtccncaggcctcgagggaggctggagtgggtncccganaagttaaaaggngtaattgagtgggacggaacaacgagactacggcttcgacccgttcgagggcaagacttaccgaccgtcctaccgagacgtaatcgtacttcccgaagttcgaacgttactcccgttagtacctaccttaacgtaaaactcgaaactacgtacccttacggaaacccgaaacccgggtagaaaccaaccgaacggtacccgtaacttaacgttacccgtacgttaaccctacgttccctacgacccaactaccgtggacccttacgtacgaaccgtaacgtaagttccgggtaccgggggg

SEQ ID NO: 143975 - DNA, 817 bp, Homo sapiens
  misc_feature: GYAE6OF01DXFXM.35.87.H10.1.454.CMB.1.raw
  modified_base (798)..(798): a, c, t, g, unknown or other
  misc_feature (798)..(798): n is a, c, g, or t
tcagtacagatcgtcacgaccggtgctcgatttagcagtactgcgttgggtttggggagctctgggagaggagcccccagccttgggattcccaagtgttttcattcagtgatcgtggtactagaacacagaggactcacctagtggtaggtttggctgagtcgtaggttcttttccgttgggtcgtatttaagtttttaaaagtcgtaccgtaggtgtggtaggttgacgtaccggtggtagggtcggtcggggacggaggttcgttaccggttaacggccgtaagggtacggttacccgtaaacggtcccttccgtcgtaggttcgtaccttacggttttacgtcggttacctttccctttacgtaacgtcggttccggtaccgttaggaacgtttaccgggtaaccggtccggtaaccggttcccgacggggtaccgtaccggggtaaaggggaaccgggtttaacgtggggtaacggtttacggggtaccgaaccgtaggttaaaaggtaaagtcttaagggtacgaggtacgggaccgtaagaacgtaccgtaacgtaccgttaccgtaccggtaccgttaagcgggtacctacggtacctaccgtacggtttccaacgtacgacgtcgttacgtcgtaacgtagtacgtacgtaccttacgtacgtactaaagtaccgtaactacgaccgaagtaccgaaccgtaaccgaacgtacaacttacgaccgtactataccgttacacgtaccctacgttcgacctaccgctacggctaccgtacgtaccggaacncggttccgtgggtacccgg

SEQ ID NO: 143976 - DNA, 775 bp, Homo sapiens
  misc_feature: GYAE6OF01BPL9S.35.87.H10.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
  modified_base (615)..(615): a, c, t, g, unknown or other
  misc_feature (615)..(615): n is a, c, g, or t
tcagtacagatcgtcacgaccggtgctcgatttagcagtactgcgttgggtttggggagctctgggagaggagccccagccttgggattcccaagtgttttcattcagtgatctggactgaacacgagaggactcaccatggagtttgggctgagctggtattttccttggtgtacttaattttaaaagttgtaccagtgtgaggtgcaccgtggtggaggtcggggcggaggtctttacggttaagcccgaagggtacggttacccctaaagcctcctccgtgtgctagtttcnggtactttcccgtttanaacgttgtacggcctggtactacgaacgtcggggtccccnccgtaggcctaccggaaggggtaacggtacgtgggtacggttggggttaccgccccggtataaagtttaaaaacggagtaagttggaacgtagggaccgggaacaaacgacggtaacctaaccggtccgtttacccgacccggttacgaacggggctaacggtactttaccgacccgtttcctaccgaagtagtacttacggtaactttccgaagttacgacgtttacctccgttagtaccttaaccaactaaagtacgaacncgaccgtaagaacccgtaaccggacgaaccacctaccggtaccttaaccgttaactttacccgacgttaacccctcgttaccaacccggaaccaacctacccgtacgacccttaaccgttaccaaccggtaacgttaacggttcccggggaaccgggggg

SEQ ID NO: 143977 - DNA, 865 bp, Homo sapiens
  misc_feature: GYAE6OF01AB6I5.35.87.H10.1.454.CMB.1.raw
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggattttcctggtgcttaattttaaaagttgtccagtgtgaggtgcaccgtgggtggaggtcggggcggaggtcttcggttaagccgagggacgggtccctaagactctcctgtcgctagtttcctggtacttccctttagaatggtccgccgtggattagaaccgttcggggtcccaccgagggcctaccggaagggggtaacgggacgttggggtaacggtttgggttccgaccccgggtataaacggttaaaaaacggggacgtaaagtttgggaggttacggggaaccggggtaaacaaaccgacggtaaccgtaaccggtctttaccgaccccggtttacgaacggggtaccaaggtactttacccgaacccgttcctaccgaaggtaacgtacttacggtactttacccgagttacggtaagttacttcccgtaggtttacccttaccgtaaaccttaaagttacggtaaacccgtacggtaacccggttaacggaaaccccggtaaacccgggaacgggtaaacccaaccggtaaccggtaccccgttaactttaaccgttacccttaccggtaaccccctaaccgtttaccgtaacccggtaaccctaacccgttaccgttaccgggaaccccttacccgtttaaccccgaacggtttaacccggttaaacggtttcccgggggtaaaccccgggggggg

SEQ ID NO: 143978 - DNA, 957 bp, Homo sapiens
  misc_feature: GYAE6OF01ECTQS.35.87.H10.1.454.CMB.1.raw
  modified_base (315)..(315): a, c, t, g, unknown or other
  misc_feature (315)..(315): n is a, c, g, or t
tcagtacagatcgtcacgaccggtgctcgatttagcagtactgcgttgggtttggggagctctgggagaggagccccagccttgggattcccaagttgttttcattcagtgatctggactgaacacagaggactcaccatggagtttggctgagctggtacttttccgttggtgtcttaattttaaagttgtacctagtgtgaggtgcaccgtggtggagtcggggcggaggtccgttacgttaacgcccgaaggggcggttaccctaagaccttcctccgtgtcgtcgtagttttcgtggtactttccctttanaagttcgtccgtcccgttagggatacggtaacgttcggggtccccgaccgtaacggtcctaccggaaggggtaacgggacgttaggggtacggttggggttaccgaccccgtaagtaaacgtttaaaaaagggacgtaaacgtttaggaaggtacgggaaccggtaaacaaccggtaaacggtacgtaaacccggtccgtttacccgtaacccgggtttacgtaacggggaccctaaggtaacctttcccgaccccgtttacggtaacccgaaggttacgaacgtttacggtaaaccgttaccgtaattacgggtaacgtttacgtttcccttaaggtttaacccttaaccgtaaacgtaaatttaaccggaaccgtaccggttaaccccgtaacggtaaaccccggaaacccgggttaaccgggaacccgtaaacccgtaacccgggttaccccgtttaaacgtttaaacccgttttaccgggttaaaaccccgtttaacccccctaacggttttaccccgtaaacgaaaccccggtttaaccctaaccccgggttaacgttaacccccgttaaacgtaaccccggttaaaaccccggtaaggggttaaaccccctttggggggtaaaaccccccgggggg

SEQ ID NO: 143979 - DNA, 786 bp, Homo sapiens
  misc_feature: GYAE6OF01DQ3PD.35.87.H10.1.454.CMB.1.raw
tcagtacagatcgtcacgaccggtgctcgatttagcagtactgcgttgggtttggggagctctgggagaggagccccagccttgggattcccaagttgttttcattcagtgatctggactgaacacagaggactcaccagtggagtttgggctgagctggtatttttccgttggtgtacttaatttttaaaagttgtcctagttgtgaggtgccaccgtgggtggaggtcggggcggaggtcgttacggttaacgccgagggtacgggtccctaagacctctccgtgtgctagttctggtacttcccttcaagtcgtccgtctggatacggacgtcgggtcccgacgacgggcctaccggaagggggaacgggacgtaggggagggttcggggttccgaccccggtaagtaaaaggttaaaacggagtaagttggagtcgggaacggaacaacgagtacctacgtcttaccgacccgttcgaggctaagtacttccgaccgttcacgagtaagtatacgtacttaccaagtacggtacttacgtcccttcgttacctaacctaaccgtaaagtaccgtaaacgaccgtaacccgtacggaaaccccgaaccggaaccggaaccctaaccgtaacggttacccctttaacgttaaacccgtttaaccgtacccgttaacccctaccgttaccgtaacccggtaacccctacgtaacccggttcgtacccctaaaccgttacccggaaaccgttaaccgggtacggttcccgggggtaacccgggggg

SEQ ID NO: 143980 - DNA, 982 bp, Homo sapiens
  misc_feature: GYAE6OF01BZWTL.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttattttaaaagttgtccagtgtgaggtgcacctggtggagtcgggcggaggtcttcggttaagccgagggacggtccctaagacctctcctgtcgctagtttctggtacttccctttagaattcggtccgtccgttggacttaggaacgttcggggttcccgccgacgggtccgttaccggaagggggtaaacggggtaccgttggggtaacgggtttcggggttaccggacccccggtaagttaaaacggtttaaaaaacgggaggttaaagttttacggaacggttacggggaacccggggtaaaccgaaaccgtaaccgggtaacccgttaacccggtacccggttttaaccccgtaacccccggggttttacggaaacgggggttacccgtaaaacgggttacccgttttaaccccggtaaccccggtttacccgttaaccggtaaaccgggtaacgggttaacgtttaccggtaaacccgttttaacccgaaacgtttaacgggtaaaccggtttaaccctttaccccggtttacggtttacccctttaaacccgtttaaaaccgtaaaacggttaaccggtaaaaccctaccggtacccggtttaaaccgggaaaccccgttaaaacccgggggaacgttaaacccgaaccggttaaccggtaccccgttaacgtttaaccgttaaccgtttacccggtaaacccgttacccttaccggtaacccgtaccctaacccgttacgtaccggtaccctaacccgttaccgaacgtaccggttaacgttccggggtaacccggggg

SEQ ID NO: 143981 - DNA, 982 bp, Homo sapiens
  misc_feature: GYAE6OF01BEC6S.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccgttggtgtcttatttttaaaagttgtccaggtgtaggaggtgcaccgtgggtggaggtcggggcggaggtctttacggttaagccgagggacgggttaccctaaggacctctccgtgtcgctagttttctggtactttcccttacaattcggtccgaccgttggacttacggaaccgttcggggttccccgaccgtagggtacccgttacccgggaaggggggtaaaccggggtacggttgggggaacggggtttcggggggtttaccgacccccgggtacgtaaaaacgggtttaaaaacggggaggttaaaagtttacgggaacggttacggggaaaccggggtaaaccaaaaccggtaacggtaacccgttaacccggtcccgtttaacccgtaacccccggggtttacggaaccgggggtaaccgtaaacggttaaccgtttaccccgtaaaccccggttcccgttaaccccggaaagggtaacggtaaccgtttacggtaaacccgttttacccgaaggtttaaccgtaacggtttaaccgttcccgtttacggtttaaccgtttaacccttaaaacgtaaacgtaccggtaaaacccgtcggtaacccccgtaagggtaaaaccccgaaacccgggttaacggaaacccctaaccggtaccggttacccgtttaacgtaaccgtttaacccgtaaccgttaccccgtaacgttcccgtaaccggtacccctaaagtacccgtacgtaaccccgttaacgtaacccggaaacggtacccgtttaacgggttcccgggggtaacccgggggg

SEQ ID NO: 143982 - DNA, 775 bp, Homo sapiens
  misc_feature: GYAE6OF01EWDH5.35.87.H10.1.454.CMB.1.raw
  modified_base (301)..(301): a, c, t, g, unknown or other
  misc_feature (301)..(301): n is a, c, g, or t
  modified_base (376)..(376): a, c, t, g, unknown or other
  misc_feature (376)..(376): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttggctgagctggtattttccgttggtgtcttaattttaaaagtgtaccagtgtgaggtgcaccgtggtggaggtcggggcggaggtctttacggttaacgccgagggacgggtccctaagacctctcctgtgctagtttcgtgtactttcccttanaagtgtcgcctggatagtaacgtcggtccgcaggccgtaccgaagggaggtcggaggagggttggtccgacccgngtaaaagttaaacggagtaagttagaggtacgggcgaaactaacggacgtaacgtaccgtactacccggtacccgttacgggacggtacgaacgttacgttacccgacggttccctacccgaaaggtactagtacgttaccgttaacctgtagtaacgttaccttcggtacgttccttaccgtaaaactaaaggttaccgtaaacgaccggttcccgtaacgtaaaccccgaacgggtaaacgacccgtaaaccaccgggttacccgttaacttaacgttaccgtaccctaaacccgtaccgttccgaacccggtaacccaacccggttaggaccgacccttaaccgttaccgaaaacccgggtactttaaaccggttcccgggggtaaacccgggggg

SEQ ID NO: 143983 - DNA, 828 bp, Homo sapiens
  misc_feature: GYAE6OF01CPULU.35.87.H10.1.454.CMB.1.raw
  modified_base (240)..(240): a, c, t, g, unknown or other
  misc_feature (240)..(240): n is a, c, g, or t
  modified_base (286)..(286): a, c, t, g, unknown or other
  misc_feature (286)..(286): n is a, c, g, or t
tcagtacagatcgtcacgaccggtgctcgatttagcagtactgcgttgggtttggggagctctgggagaggacgccccagccttgggattcccaagttgttttcattcagtgatcgtggactgaacacagaggactcaccagtggagtttgggctggagcgtggtactttttccgttggtgtattaagtttttaaaagtgttaccagtgtggtaggtcgctaccgtggtggaggtcgggnggagtctacgtaacggccgaggtcggtaccctaagccttctcgtgngcgttagttcgtgtacttcctttacgattcggtccgcgttaggtatacggtaaccggtccgggtaccccgcggtaccggcctaacccgggaaggggaacgggtaacgtgggtaacgggttcgggtccgaaccgtaggtaaaagttaaaggagttaacggtggaacgtgggaaccggaacaacgaacggtaccgtaccggtacctacccgtacccgggttaacgacgggactaacggtacctaacccgttcccgttaccgttacccggaggttaaccgtacgtacgttaaacgttccgtaacgtagggtaactttcccgttaacccgtttcggttaaaccgtacccttaaagttaaacggtaccggtaaaccttacggacccgttaaaccgaaccgaaaccccgggtagaaacccgtacgaacccgtaccggttaaccttacggttaacctaccgtaaccctacgttccaaccgaacctaccgacgttacgtactacccggttaacacccggtaagtacgggtttcccggggtaacccggggg

SEQ ID NO: 143984 - DNA, 980 bp, Homo sapiens
  misc_feature: GYAE6OF01C79XT.35.87.H10.1.454.CMB.1.raw
  modified_base (160)..(160): a, c, t, g, unknown or other
  misc_feature (160)..(160): n is a, c, g, or t
tcagtacagatcgtcacgaccggtgctcgatttagcagtactgcgttgggtttggggagctctgggagaggacgccccagccttgggattcccaagttgttttcattcagtgatcgtggactagaacacagaggactcaccagtggtaggtttgggctgngtcgttgttactttttccgtggttcgtacttttaaagtttttaaaaacggtttcgtaccgtaggtttggtaggtacgggttcggcccgtaaccgggtttggggtagggtaacggggtcccgggggacgggtacgggttaccgttttaccgggttaaacggaccccgggtaaacggggtaaccggggttaaccccgtaaacggtaccccgttccgtttcccgttggtcgttccgtttaacggttttccgtacggttacctttttcccgtttaacgtaacggtttcgtcccggtccgtaggtagtacggtacggtccgggtacccgccggaccggtccggtaacggggaacggggtaacgggacgggtgggtacggttacgggttcccgaacccgtaagttaaaaggtaaaaggggaattaaggttaggtacggtaccggggtaacggaaaccgaacgtaacggtaaccgttaaccggtccttacccggtaccggtacggacggtactaacgggttacctaccgttacccgtaaccgtacgacggtaagtacgttaacgtactttaccgtaagttcgttaacgttacctttaccggttactaccgttaaaacgttaaccgtaaacgtaacggtaaccgaaccggttaaccgaaccggtaacccggaaaccgtacggtacccgaacgtaccgttaccgttaacttaacgttaacccgttaccgttaacctacgttacccctagaaacccgtccggtacgtacccggttaacctacgttaacgaaccggttaacccggttacgggttccggggtaacccggggg

SEQ ID NO: 143985 - DNA, 697 bp, Homo sapiens
  misc_feature: GYAE6OF01A3YE1.35.87.H10.1.454.CMB.1.raw
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
  modified_base (540)..(540): a, c, t, g, unknown or other
  misc_feature (540)..(540): n is a, c, g, or t
tcagtacagatcgtcacgaccggtgctcgatttagcagtactgcgttgggtttggggagctctgggagaggagccccatccttgggattcccaagtgttttcattcagtgatctggactgaacacagaggactcaccatggagtttgggctgagcgtggtatttttccttggtgacttaattttaaagttgtccagtgtgaggtgctacctggtggagtcggggcggaggtcttacggttaagccgagggtacggtccctaagacctctcctgtgctagttcngtacttccttnatgtcncgtgatagacgtggtccgcgaggtcctacgagggaacggcgtggaggttgggtacgacccgagtaagttaaaacggngtaagtaggagtcgggacggaacaagacgaactaccgtccttaccgtacccgttcgacgggactacggtaccttaccgaccgtcctaccgaagtagtactacgtacttaccgagtacgtagttaccttcgttagtaccttaacctaacgtaaacgtacgaacnccgtacgtaacgaacccgaaccgtaaggacctacgacgttacccgtacttaaccgtaccgtttaccacccacgttacccgtaccgaaccctactacccggtgaaccctacccggttacgaacggtaccgttaagggttcccgggtaaacccgggggg

SEQ ID NO: 143986 - DNA, 791 bp, Homo sapiens
  misc_feature: GYAE6OF01CF0ZM.35.87.H10.1.454.CMB.1.raw
tcagtacagatcgtcacgaccggtgctcgatttagcagtactgcggttagggtttggggagctctgggagaggacgccccagccttgggattcccaagtgttttcattcagtgatctggactgaacacagagactcaccatggagtttgggctgagctggtattttccttggtgtcttaattttaaaagttgtccagtgtgaggtgcacgtggtggagtcgggcggaggtccttcggttaaagccgaagggacgggttaccctaaaggaccttctcctggtgctagtttctggtactttccctttcaattgtccgtcctaggatacgaaccgttggggtaccccgccgaagggccttaccggaacgggggaaaggggtaccgttaggggtaacgggtttcggggttccggaccccggtaacgttaaaacggtttaaaaaaggggagttaaaacggttgggtaaggttcggggaaccggggtaaacgaaacgtaaacggaaccgtttaacccggtcctttaacccggaacccggttttacggaacggggtacctaaggtaacctttacccgacccggttaccttacccgaaggaacgtattacgtaaccttaccaagttccggaattaacttcccgttagtaccttactaactaaagtacgaaactacgtacctagaacccgaaacggtcgaactaccgacggtccttaactattaaccgtacgtacctactcgtacacccgctacgtcgaaccctacttacgaaccgttacgtagtccggtacccgggggg

SEQ ID NO: 143987 - DNA, 731 bp, Homo sapiens
  misc_feature: GYAE6OF01CFMBT.35.87.H10.1.454.CMB.1.raw
  modified_base (387)..(387): a, c, t, g, unknown or other
  misc_feature (387)..(387): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagttgggctgagctggtattttccttggtgcttattttaaaagtgtccagtgtgagtgcacctggtgagtcgggcggaggctttcgttaagccaggacgggtccctaagactctcctgtcgctagtttctggtacttcccgtttcaatcgttccgacccttggattaggtaacgttcgggtcccgaccgacgggccttaccggaggggtaagggtctggggtagttcggggttcgacccccggtanaaggtttaaaaagggacggtagtttagagttcggagggtaacaaacgagtacgtaacgtccttacgaccccggttacgagggctaaggtactttaccgacccggttcctaccgtaaggaacgtcgttacggaatttaccgagtacggtaactaccttaccgttcgttacctacgttaaacgaaatccgaaaccgtacgacccgttacgaacccgtaaacccggaggaacccgacgttaaccgcccgtttaactaacgtttaccgtaccgtaaccctaccgtttcgaccctaccgaacctacctgaccgtactccgaagttaacgtcgttaccgggtaccggggg

SEQ ID NO: 143988 - DNA, 775 bp, Homo sapiens
  misc_feature: GYAE6OF01CZY68.35.87.H10.1.454.CMB.1.raw
  modified_base (607)..(607): a, c, t, g, unknown or other
  misc_feature (607)..(607): n is a, c, g, or t
tcagtacagatcgtcacgaccggtgctcgatttagcagtactgcgttgggtttggggagctcgtgggagaggagccccagccttgggattcccaagttgttttcattcagtgatctggactgaacacagaggactcaccatggagtttggctgagcgttggtattttccgttggtgtactttaattttaaaagttgtaccgtagtgtggaggtcgcgtaccgtgggtaggaggtcgggcggaggtcgttacggttaaagccgtaacgggtacggttacccgtaaaggacttccgtccgtgtcgtcgttaggttcgtggttaccttcctttataagttcgtccgtccgtaggtagtacggtaaccgttcgggtaccccgtcgacgggtcctacggaacggggaggtacgtagggacggttgggtaccgacccgtaagttaaacgttaaaacggtagtaagttacggagtacgggtaaccggaacaaacgacgtaacctaccggtaccttaaccgtacccggttgaacgggtccagtaccttccgtaccgttcctaacgacgtaagtcgtaacgtacttaccgtaagtacgtaactttcgttacccgtntaacctactaaacgtaacaacgtaccgactaccgtacgaaaccggaccgtaagaccgaacgttaccggtaccttactaaccgttcgaacctccgtactacccgactaaccctcgtacgtactacttacccgttaacgacggttacgtaccggttcggggtaacccggg

SEQ ID NO: 143989 - DNA, 1199 bp, Homo sapiens
  misc_feature: GYAE6OF01EYC3X.35.87.H10.1.454.CMB.1.raw
tcagtacagatcgtcacgaccggtgctcgatttagcagtactgcgttgggtttgggggagctctggggagagggagccccagccttggggattcccaagtgttttcattcagtgatctggactgaacacagaggactcaccagtgggtagttgggctgagctggttacttttccgttggtgtactttaaagtttttaaaaggttcgttacctaggttgtaggtaggttgaccgtaccgttggggttagggacgggttccggggggacgggtacgggttccgttttaccgggttaaacggccggtaaggggtaccgggggttaaccccctaaaggtacccttccgttcccgttggttcggtaccgtttaacggtttttccggtacgggttaccctttttaccccgttttacgtaaacgtttccgggttcccgtacccggttaggggtaaccgttacgggtaaaccgggtttcccggggggtacccccgggtacccggaccgggggttacccggtaacccggggtaaacggggggggtaaaccggggtacgggtttaggggggtaacggggtttccggggggtttacccggaccccgggttaacggttaaaaaggggtttaaaaaacgggggtaaacgggtttaaaacggttttcggggaaacggggttaccggggggaaaccccggggtaaaacggtaaaacccgggtaaccggtaaacccgggtttaaccccggttacccccggtttaacccccggttaaccccccgggggtttaccgggaaaccggggttaccggtaaaacccggtttaccggtttaaccccgtaacccccggggtttaccctaacccgggtaaacggtaacgggttaacctttaccggggtttaaacctttaaccccggtaaggttaacggtacccggtttaaccgtttcccggtttaaccgtttacccgtaaacgttaaaacccgtaaacgtaacccggtaaaccgtaccgtaaccccggtaaccgaaacccggtaacccgggaagtaaccccgacggtaacccgtacccgttaacgttaaacctttacccggtaaacccgttaacccccgttaacgtttccccgtaaaaccccggaaccccctaaaccgggttaacccgttcccgggtaaacccttaaacccccgtaacccggggttaaacccggtaacccgttt

SEQ ID NO: 143990 - DNA, 844 bp, Homo sapiens
  misc_feature: GYAE6OF01CBA71.35.87.H10.1.454.CMB.1.raw
  modified_base (703)..(703): a, c, t, g, unknown or other
  misc_feature (703)..(703): n is a, c, g, or t
  modified_base (792)..(792): a, c, t, g, unknown or other
  misc_feature (792)..(792): n is a, c, g, or t
tcagtacagatcgtcacgaccggtgctcgatttagcagtactgcgttgggtttggggagctctgggagaggagccccagccttgggattcccaagttgttttcattcagtgatctggactgaacacagaggactcaccatggagtttggctgagcttggtactttttccgttgggtcgtactttaaagttttttaaaaaggtttcgtccctaaggttggttggaacgggttgcctaccgttgggtgggacggttccgggggacggtaggtcctttacggttaaacggccgaagggtacgggttacccctaaaggtaccgttccttccgttggtcgtacgttacggttttcgtcggtaccttttcccgtttacgaacgttcggtccgaccgttaggtacgttacggtaaccggtttcggggtacccccgaccggtagggtacccgtaccccgggtaaagggggtacgggtacccggtaaggggttgggttccggggttccgacccccggttagtaaagggtttaaaaaggagttaagtttggaacggtcggtaaaccgggaacaaacggtaccgaacgtacccgtacctttcccggaacccgttcggaacgggacctaacggttacctttacccgaaccgttcctacccgaggtaacgtacgtacgtacctacgtagtagtacgtacttcgtcttactactaanacgtacgaactcgtaaccgactaacccgaagggtacaaccgtacgcgtaccgtacttacgtacctacgtaccctaccgtcgtacacccngtaccgtcggtaacctcgttaaccgacggtaacgtcggttccgggaccgggg

SEQ ID NO: 143991 - DNA, 816 bp, Homo sapiens
  misc_feature: GYAE6OF01CEQC0.35.87.H10.1.454.CMB.1.raw
  modified_base (782)..(782): a, c, t, g, unknown or other
  misc_feature (782)..(782): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccagtggagtttggctgagctggtattttccgttggtgcttaattttaaaagtgtactagtgtgaggtgctaccgtgggtggaggtcggggacggagtcttcggttaacgccgagggaccgggttacccaagtacctcgtccgtaggtcgtacgttagtttcgtcgggtaccttttcccctttactaacttcggtccgtccgtggtaacgtacggaaccggttcgggtacccgaccgtacggaccgttacccgggaaggggtaacgggaccggttaggggacgggtttcgggtaccgtacccggtaacgtaaaaggtttaaaaagggacgtaaagtttacgggaggttacggggaaccggtaaacaaacgtacggtaaccgtaacggttaccttacccgtacccggttacggaacgggtacctaacgtacgttaccgacccgttaccgtaccgtaacggtaagtacgttaacgtaccctttaccgtaagtacgttaacggtttaccgtacctttccgtacttaactaaccgtaaatacgaaaccgtacgtaccgtaacgaaacccgaaccgggaacgaaccctacgtacgtccgttactaacttccgtacctaaccgtccgtcgtacgaccctcgtacgcgttaccncgtacgaacggtcgtacggttccgggtaccgggg

SEQ ID NO: 143992 - DNA, 680 bp, Homo sapiens
  misc_feature: GYAE6OF01AWJF7.35.87.H10.1.454.CMB.1.raw
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
  modified_base (374)..(374): a, c, t, g, unknown or other
  misc_feature (374)..(374): n is a, c, g, or t
  modified_base (508)..(508): a, c, t, g, unknown or other
  misc_feature (508)..(508): n is a, c, g, or t
  modified_base (604)..(604): a, c, t, g, unknown or other
  misc_feature (604)..(604): n is a, c, g, or t
tcagtacagatcgtcacgaccggtgctcgatttagcagtactgcgttgggtttggggagctctgggagaggagccccagccttgggattcccaagttgttttcattcagtgatctggactgaacacagaggactcaccatggagtttgggctgagctggtattttccgttggtgtcttaagttttaaaagttgtcctagtgtgaggtgcacgtggtggagtcgggcggaggtcttacgtacgccgaggacggtccctaagctctcgtgtgctagttcngtacttcccttnatcgtcgcctgatcgacgtcggccgacgaggccacggagggacggtacgnggtaggtcgggtcgacccgtataagtaaaacggngtaagtagagtacgggacgtaacaacgacgtacgtaccgtcgttacccgacccgttacgacggactaagtaccttaccacccgtcgtacccaagtacgatacgtactaccgtaagtcgtacgttactcccgttnaccttacaacctaaagtgaaccacgtacctaacggaaccgaaaccggtacgaaccaccgtacggacccttagtaaccttaccgtaccgttaacccncgttaccgtaccgaccctaactccgacgtaccctccgtaaccgaacgaccgggttcgttaccggggaccccggggg

SEQ ID NO: 143993 - DNA, 734 bp, Homo sapiens
  misc_feature: GYAE6OF01CIWI0.35.87.H10.1.454.CMB.1.raw
  modified_base (322)..(322): a, c, t, g, unknown or other
  misc_feature (322)..(322): n is a, c, g, or t
  modified_base (597)..(597): a, c, t, g, unknown or other
  misc_feature (597)..(597): n is a, c, g, or t
tcagtacagatcgtcacgaccggtgctcgatttagcagtactgcgttgggtttgggagctctgggagaggacgccccagccttgggattcccaagtgttttcattcagtgatctggactgaacacagacggactcaccatcggagtttgggctgagtctcggtattttccgtggtatacttaagttttaaaaacgtgttcccgtaagttcgtagacggttcgactacgtggtggacgtcggcggagtccttacgtaagccgtaggacgttacccaagctacgtccgtgtcgtaccttagttacgtggttaccttcccgttanagtcgtacgcctggatacgaccgttcggccgaccgacggtccgtacgaaggggtacggtacctggggaacgttcggtcggaccccgtaataaaggttaacgaagagttacgtagcggacccgaataacggactacgtaccgtctaccgtaccgtggaagcgacgttacgtccccgaaccgttcgaccgtaacggagtacttaacgtaacttacccgtaagttacggtacgttaccttccttcggttaccctacttaacgtaaagtctaaccgacnccgttaaacgacccgaacggtaacgtaccgaacgttacgaccgttaccttaggtacctttacggaacccctacggtctaaacgtcccaagtccgtaccgtactactacccaaggtaacgttccgcgggtaacccggg

SEQ ID NO: 143994 - DNA, 814 bp, Homo sapiens
  misc_feature: GYAE6OF01ET2RU.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgtcttaatttttaaaagttgtccagtgtgaggtgcaccgtggtggagtcggggcggaggtcgtttacggttaagccgagggtacgggtaccctaagacctctcctgtcgacgtagtttcgtggtactttccctttacaagttcgtccgccgttggtatacggtaacgtcgggtcccgccgtacggcctcggaaggggaacgggacgtgggtaggtcgggttcgacccgtagtaaagttaaaagggagtaagttggagtacgggacggaacaaacgacggtaaccgtacgtaccgtttacccggtaaccccgttacgggacgggtacgtaacggtactttacccgtaacccggttcctaacccggtaagacggttaacgtcgttaaccttaccgtaagttacgtaacgtttacttcccgttagttacccttactaaaccgttaaagtaccgaaactaccggcctaaacggaaacccggtaaccggaacggaacctacgaaccggttacccgttaacttacgtttaaccttaccggtaaccccttacgttcccgtaaccggaaccctacccgtaccgttaaccggacccttacccggttaacaaacccgggtaacgttaacggttcccgggggtaacccgggggg

SEQ ID NO: 143995 - DNA, 934 bp, Homo sapiens
  misc_feature: GYAE6OF01DX4EK.35.87.H10.1.454.CMB.1.raw
tcagtacagatcgtcacgaccggtgctcgatttagcagtactgcgttgggttggggagctctgggagaggagccccagccttgggattcccaagtgttttcattcagtgatctggactgaacacagaggactcaccatggagttggctgagctggtacttttccgttggtgtacttaagttttaaaagttgtccagtgtggaggttgccaccgtggtggacggtccgggacggtaggtcctttacggttaacgcccggtaagggtacggtacccctaaagtaccgttcctccgttaggtcgtaccgttacggtttcgttacgggttaccttttacccccgtttagtaaacgttccggttacccggtaccgttggggtaacttacgggtaaaccggttccggggtcccccgtaccgaacgggtcccgtaacccggaagggggtaaccggggtacgttaggggacgggttcggggtaccggtaccccgtaaacgtaaaaggttaaaacgggagtaagtttacgggaacggtcgggaaccgggtaaacaaacgtacggtaaccgtaccggtacccgtttacccgaaccccggttggaacggactaacgtaccgttaccgcccgttaacctaccgaaggtaacgacgttaacggttaccttccggtaaagtccggtaagtttcccgttccgtacgtttactaacccgtaaaacgtaaacgtacgaaacccgtacggtaccccgtaacggaaaccccgtaaaccgggaacggtaaacctaccccggttaaacgggttccccttaaacgttttaaccgttaacccgaaccggtttacccctaaccggttacccttacccggaaacctaccggtaaaccgttcgaacccctttacggtaacccgaaccgttaacggttaccgggttccgggtaaccggggg

SEQ ID NO: 143996 - DNA, 648 bp, Homo sapiens
  misc_feature: GYAE6OF01A7HJS.35.87.H10.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (503)..(503): a, c, t, g, unknown or other
  misc_feature (503)..(503): n is a, c, g, or t
  modified_base (525)..(525): a, c, t, g, unknown or other
  misc_feature (525)..(525): n is a, c, g, or t
  modified_base (534)..(534): a, c, t, g, unknown or other
  misc_feature (534)..(534): n is a, c, g, or t
  modified_base (589)..(589): a, c, t, g, unknown or other
  misc_feature (589)..(589): n is a, c, g, or t
  modified_base (603)..(603): a, c, t, g, unknown or other
  misc_feature (603)..(603): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgctattttaaaagttntccagtgtgaggtgcactggtggngtgggcggaggcttcgtaagccgaggagggtccctaagctcgtcctgtgctagtttctggtactttcccgttttcaagttcgtccgtccttaggattacggaaaccgttcggggtacccgcccgtaagggcctacccggtaagggggaaacgggtaccgtggggaacggttcgggggtttcaccccggtacgtaaagtttaaaaacgggagtaaagttggaagtcgggacggtaacaacgagaccgttacgccttcgaaccgttcgaggccagtactcgaccgtctacaganagtgacttcagtgaagtctctntcacgtaanaatgaacagtcctagaaccaaccggagtaacccagaacgccgtactacgttaacncgtaaccactcgtnaccctagcctggactaccttacaacggactacgttcggaccgggg

SEQ ID NO: 143997 - DNA, 680 bp, Homo sapiens
  misc_feature: GYAE6OF01A2M1T.35.87.H10.1.454.CMB.1.raw
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (559)..(559): a, c, t, g, unknown or other
  misc_feature (559)..(559): n is a, c, g, or t
  modified_base (569)..(569): a, c, t, g, unknown or other
  misc_feature (569)..(569): n is a, c, g, or t
  modified_base (643)..(643): a, c, t, g, unknown or other
  misc_feature (643)..(643): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttggctgagctggtatttttccttggtcgtctttaattttaaaaagttcgtccaggttggtgacggtgctaccgtgggtggaggtcggggcggaggtcttacggttaacgccgagggtacgggtccctaagacctctccgtgtcgcgtagttttcgnggtaccttccctttacaacgttcgtccgtcctggtaacgtcggtaacggtccgggtcccncgtaacggtccgtaccggaggggtaacggacgtgggtacggttcgggtcgcccgataaaggtaaaaaggagtaagtggtaacggtcggaacggaacaaacgaacgaccgtacgccgttaccgacccgttagacgggactaacgtacttccacccgtctaccgagtacgatcgtactcagtgtatctctgtactacaanaactgacacnccgtaacgaaccgaacgacgacaacgcgtacctacgttactacgtaccgtacctactccgacaccacgcgtacnctacttacgacgtacgtaacgttcgggtaaccggggg

SEQ ID NO: 143998 - DNA, 525 bp, Homo sapiens
  misc_feature: GYAE6OF02JJOKJ.35.87.H10.1.454.CMB.1.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (384)..(384): a, c, t, g, unknown or other
  misc_feature (384)..(384): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctatttaaagttgtccagtgtgaggtgcacctggtggagtcgggcggaggcttcgttaagccaggagggtccctaagactctcctgtgcagtttctggattcccttnaatgtcgcctggatgaactgggtccnccaggctccagggaggctggagtgggttncccgnattaaaggngaattgatggcggacaacagactacgcttgacccgttnagggcagattcgaccgtctccagagatgattccatgagtatcctgtctctacaaatgaacagcctgacaaccgaggacacagccgtctattactgtaccactctgaccacactggactacttcacgacacttcgtacgggg

SEQ ID NO: 143999 - DNA, 543 bp, Homo sapiens
  misc_feature: GYAE6OF02H32ZG.35.87.H10.1.454.CMB.1.raw
  modified_base (354)..(354): a, c, t, g, unknown or other
  misc_feature (354)..(354): n is a, c, g, or t
  modified_base (404)..(404): a, c, t, g, unknown or other
  misc_feature (404)..(404): n is a, c, g, or t
  modified_base (477)..(477): a, c, t, g, unknown or other
  misc_feature (477)..(477): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattccctttcaatgtcgcctggatgaactgggtccgccaggctccgagggaggactgggagtgggttgccgcagttaaaaggngaattgatggcgggacaacagactacgcttcaccgttcagggcagattcnccgtctccagagatgattccatgatatcctgtctctacaaatgaacagcctagacaaccgagacacagccgtntattactgtaccactctacgaccacctactggactacttccaacgtactaagttccgtacgggggg

SEQ ID NO: 144000 - DNA, 547 bp, Homo sapiens
  misc_feature: GYAE6OF02HQS68.35.87.H10.1.454.CMB.1.raw
  modified_base (279)..(279): a, c, t, g, unknown or other
  misc_feature (279)..(279): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (387)..(387): a, c, t, g, unknown or other
  misc_feature (387)..(387): n is a, c, g, or t
  modified_base (510)..(510): a, c, t, g, unknown or other
  misc_feature (510)..(510): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcgggcggaggcttcgtaagccaggagggtccctaagactctcctgtgcagtttctggattccctttnaatgtcgcctggatgaactgggtccgccaggctccagggaggactggagtgggtncccgnattaaaggngaattgatggcggacaacgagactacgcttcacccgttnagggcaggacttcgaccgtctacccagagatgattccatgagtatcctgtctctacaaatgaacagcctagaaccaaccgaggacacagcctactaattactgtacctacctctacgacccanacctggaccacttccaaccgtacgattccgacggggg

SEQ ID NO: 144001 - DNA, 567 bp, Homo sapiens
  misc_feature: GYAE6OF02GJEVC.35.87.H10.1.454.CMB.1.raw
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattccctttcaatgtcgcctggatgaactgggtccgccaggctccgagggaagggctgggagtgggttgcccgcaagttaaaaggngaattgatggcgggacaacgagactacgcttgacccgttnagggcagacttcaccgtctccagagatgattccatgatatctgtctctacaaatgaacagctagacaaccgagacacacgccgtatattactctaccacctcgtacgaccctaacaccgttcggcctaccgtttaccgaaccgtaaccgtacttccggtaaccggggggg

SEQ ID NO: 144002 - DNA, 703 bp, Homo sapiens
  misc_feature: GYAE6OF02IJTBA.35.87.H10.1.454.CMB.1.raw
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagcgtggatttcctggtgctatttaaagtgtcagtgtgaggtgcacgtggtggagtcgggcggaggcttcgtaagccgagggacggtcctaagctctcctgtgctagtttctggacttcctttcaatgtcgcctggatgacgtgggtccgccaggctccgagggaaggtcgtggagtgggttcgcccgngtaagttaaaaggngtaaagttggaagtcgggaccgggaacaaacgacgtacgtaacgtcgttccgtaacccggttacgaacggggcaacggtaagtttccaaccggtcgtaccgaaggaacgtatcggtaacttccgaagtacggtaacgtactccgtacgttaccttacgtaaacctaaagtcgaaacgacgttacccgagaacccgtaaccgggaagtaacccgaacgtaacgggtcctaaaccttacgttaaccgtagttaaccctaaccgttcccgttaacgaaccctaaccgtaacgtaccggtaccttaccgtacccgtaaccggtaaaccgtacgtttaccgggaacccggggg

SEQ ID NO: 144003 - DNA, 781 bp, Homo sapiens
  misc_feature: GYAE6OF02J3UGQ.35.87.H10.1.454.CMB.1.raw
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagttgggctgagctggtatttcctggtgcttatttaaagttgtccagtgtgaggtgcaccgtggtggaggtcgggcggaggtcttcggttaagccgagggacgggtccctaagactctcctgtcgctagttcnggtacttccttnagtgtcgcctggatgacgtggtccncgaggctacgagggaggcgtggngtgggtcgccgataagttaaaggngtaagtggagtcggacggaacaacgagtacctacggtcttaccgaccggttacgacggggtctacggtacttccgaccggttactaccgaaggtacgtacgtaccggttaacgttcccgtaagttacggtaacgttaccgttacccgttaacggttacccttaaccgtaaaacgtaaacggttaaccggaaaccgtaaccggttacccgttaaacgggaaaccccggtaaaccggtaaccggtaaacccgtaaccggtaacccggtacccgtttaaacgtttaccttaaacccggttaccgtaaccccgtaccgtaaccccgttaacgaaacccccgttaaccgtaccgtaccgggttaccccttaaccggttacccgaaccgggtaacccgttaccgggttaccgggttaaccccggggggg

SEQ ID NO: 144004 - DNA, 540 bp, Homo sapiens
  misc_feature: GYAE6OF02I3PML.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattccctttcaatgtcgcctggatgaactgggtccgccaggctccagggaagggactgggagtgggttgcccgcattaaaaggagaattgatggcgggacaacagactacgcttcacccgttcaggggcagattcaccgtctccagagatgattccatgagtatcctgtctctacaaatgaacagcctgacaaccgaggacacagcccgtatattactgtaccactctagaccacactggcacttccacgacgtacgttcgtacggggg

SEQ ID NO: 144005 - DNA, 549 bp, Homo sapiens
  misc_feature: GYAE6OF02JBQO1.35.87.H10.1.454.CMB.1.raw
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (514)..(514): a, c, t, g, unknown or other
  misc_feature (514)..(514): n is a, c, g, or t
tcagtacagatcgtcacgaccggtgctcgatttagcagtactgcgttggggtttggggagctctgggagaggagccccagccttgggattcccaagtgttttcattcagtgatctggactgaacacagaggactcaccatggagtttgggctgagctggattttccttggtgctatttaaagttgtccagtgtgaggtgcacctggtggagtcgggcggaggcttcgttaagccagggagggtccctaagactctcctgtgcagtttctggattcccttnaatgtcncctggatgaactggtccnccaggctccgagggaacggctggagtgggttgcccgnagttaaaagggngaattggatgggcgggacaacagactacgcttcaccgttcagggcagactcaccgtnccagnatgattccatgagtatcctgtcctctacaaatgaacagcctagaccaacgagaccagtacgccgtatacttactagtaacccactctacgacctaacncgtcggctacgttcaacgacgattccggtacgggg

SEQ ID NO: 144006 - DNA, 548 bp, Homo sapiens
  misc_feature: GYAE6OF02HGCWV.35.87.H10.1.454.CMB.1.raw
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
  modified_base (461)..(461): a, c, t, g, unknown or other
  misc_feature (461)..(461): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggacttccctttcaatgtcgcctggatgaactgggtccgcaggctccgagggagggactgggagtgggttcgcccgnaagttaaaaggngaattgatggcggacaanagactacgcttcaccgttnagggcagtacttcacgtctccagagatcgattccatgagtatcctgtcctactaacaaatcgaacngcctagaaccaacgagacacacgctctatctctaccactcacgaccactactgcctacgttaccacgtacgtacgttcggtcggggg

SEQ ID NO: 144007 - DNA, 530 bp, Homo sapiens
  misc_feature: GYAE6OF02FFZ77.35.87.H10.1.454.CMB.1.raw
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (478)..(478): a, c, t, g, unknown or other
  misc_feature (478)..(478): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccagggagggtccctaagactctcctgtgcagtttctggattccctttcaatgtcgcctggatgaactgggtccnccaggctccagggaaggactggagtgggttgcccgcattaaaaggngaattggatggcgggacaacagactacgcttcaccgttcagggcagatcaccgtctcagagatgatccatgagtatcctgtctctaacaaatgaacagcctgaacaaccgaggacacagccgtntattactgtaccactctgaccacactggcacttccacgacgattcgcggggg

SEQ ID NO: 144008 - DNA, 508 bp, Homo sapiens
  misc_feature: GYAE6OF02GQ8JS.35.87.H10.1.454.CMB.1.raw
  modified_base (408)..(408): a, c, t, g, unknown or other
  misc_feature (408)..(408): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgaagcgtctggattcatctcaataactatggcatgcacgtgggtccgccaggcctccgaggcaaggggctgggagtggttggcagttgtgtggtatgatggaatatagatactatgacagacacgtgaagggccatcacatctcaganacaattccaagtaactactttgtccagaccaaatcgaacagcctagacgacgccgagacacggcgaatatatactgtgacgagagcgagcggactacccg

SEQ ID NO: 144009 - DNA, 360 bp, Homo sapiens
  misc_feature: GYAE6OF02IE06Z.35.87.H10.1.454.CMB.1.raw
  modified_base (358)..(360): a, c, t, g, unknown or other
  misc_feature (358)..(360): n is a, c, g, or t
tcagtacagatcgtcacgaccggtgctcgatttagcagtactgcgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggcctgggctgcctggtcaaggactacttccacgatctgtactgagcgggctggcaaggcgcatagnnn

SEQ ID NO: 144010 - DNA, 570 bp, Homo sapiens
  misc_feature: GYAE6OF02GCZTN.35.87.H10.1.454.CMB.1.raw
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
  modified_base (459)..(459): a, c, t, g, unknown or other
  misc_feature (459)..(459): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaagttgtccagtgtgaggtgcacctggtggagtcgggcggaggcttcgttaagccagggagggtccctaagactctcctgtgcagtttcnggattccctttnaatgtcgcctggatgaactgggtccgccaggctccgagggagggctgggagtgggttgcccgnagttaaaaggngaattgatggacgggacaacagactacgcttcacccgttnagggcagattcaccgtctccagagatgattccatgatactcctgtcctactaacaaatgaaacngcctagaccaaccgaggaaccaacgacgccgtactaacttaccgtcgtacccacgttcacgaacccacacgtcgcctacttacccgacgtaacgtacttccggtacggggg

SEQ ID NO: 144011 - DNA, 551 bp, Homo sapiens
  misc_feature: GYAE6OF02FPLCD.35.87.H10.1.454.CMB.1.raw
  modified_base (281)..(281): a, c, t, g, unknown or other
  misc_feature (281)..(281): n is a, c, g, or t
  modified_base (343)..(343): a, c, t, g, unknown or other
  misc_feature (343)..(343): n is a, c, g, or t
  modified_base (481)..(481): a, c, t, g, unknown or other
  misc_feature (481)..(481): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattccctttnaatgtcgcctggatgaactgggtccgccaggctccagggaagggctggagtgggttgcccgnagttaaaaggagaattgatggcgggacaacagactacgcttcacccgttcagggcagacttcaccgtctccagacgatgattccatgagtatcctgtctctacaaatgaacagcctagacaaccgagacacagccgtntactacctgtaccactctagacccactacctggacctaccttacgaccgtacgtacttccggtacggggg

SEQ ID NO: 144012 - DNA, 623 bp, Homo sapiens
  misc_feature: GYAE6OF02ICCUD.35.87.H10.1.454.CMB.1.raw
  modified_base (412)..(412): a, c, t, g, unknown or other
  misc_feature (412)..(412): n is a, c, g, or t
  modified_base (579)..(579): a, c, t, g, unknown or other
  misc_feature (579)..(579): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggatttccttggtgctattttaaaagttgtccagtgtgaggtgcacctggtggagtcgggcggaggcttcgtaagccaggagggtccctaaggactctcctgtgcagtttctggattccttcaatgtcgcctggatgaacgtgggtcccgcctagctccgagggaggactggagtgggttcgcccgagtaagttaaaaacgggagtaaagttgaagtcggacgggtaacaacgagactaacgcttaccgacccgtnacggggacacgatttccgaccgtcaccgaaggacgaactaggtacttaccgaagttcgaagttactccgttagtcctacgtaactaaaagtcgaaacctagcccttagaacccgaaacgcgaacaccgacgccgtactaacttacacgtaaccacgtctacgaaccncctaacgtcgtacaaccttcaaccggactacgttcggaacgggg

SEQ ID NO: 144013 - DNA, 565 bp, Homo sapiens
  misc_feature: GYAE6OF02IMG0P.35.87.H10.1.454.CMB.1.raw
  modified_base (356)..(356): a, c, t, g, unknown or other
  misc_feature (356)..(356): n is a, c, g, or t
  modified_base (417)..(417): a, c, t, g, unknown or other
  misc_feature (417)..(417): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattccctttcaatgtcgcctggatgaactgggtccgccaggcctccgagggagggactggagtgggttgcccgcagttaaaaggngaattgatggcgggacaacgagactacgcttcaccgttcagggcagattcaccgtctcagngatgattccatgagtattccgtgtcctctaacaaatgaacagcctagaccaaccgaggaacacgaacgcctactaacttactcgtaacccacgtcctagaacccaacacctggaccaccttcaaccggaacgtacttcggtacggggg

SEQ ID NO: 144014 - DNA, 899 bp, Homo sapiens
  misc_feature: GYAE6OF02H4XP8.35.87.H10.1.454.CMB.1.raw
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcggggcggaggcttcgttaagccagggagggtccctaaggacctctcctggtgctagtttcnggtactttcccctttnaatcggtcgcctggatgaactgggtaccncaggctccgaggggacggactgggagtggggttcgcccgtacgaagttaaaagggagtaaacgttggaagttcggggacggggaaacctaacgtaacggaaccgttaaccggtcctttaaccggaaccccggtttaccgaaacgggggtaccctaaacggtacgttttaccccgtaacccggttacctaccccgaagggtaaaccgtaacgttaggtaaccctttacccgaagttacgggtaacgtttaaacctttccccgttagggtttacccttaaccgttaaaccgtaaaaacgttaccggaaaaaccctacggggttaaccccttaaaccggggaaaacccctaaaaccccggggtaaacgggaaacccctaaacccggtaacgggtacccccggttttaaaccgttaaaccgttttttaaaccccgtaccgggtttaaaacccccctaccggtttaaccgttaaccgaaaccccccgttaaacgtaacccgtcccggggtaacccttacccttttaaccccggaaacccgggtaaccggttaaacggtttccccgggtaaacccgggggggggg

SEQ ID NO: 144015 - DNA, 557 bp, Homo sapiens
  misc_feature: GYAE6OF02HW5IM.35.87.H10.1.454.CMB.1.raw
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (405)..(405): a, c, t, g, unknown or other
  misc_feature (405)..(405): n is a, c, g, or t
  modified_base (435)..(435): a, c, t, g, unknown or other
  misc_feature (435)..(435): n is a, c, g, or t
  modified_base (474)..(474): a, c, t, g, unknown or other
  misc_feature (474)..(474): n is a, c, g, or t
  modified_base (500)..(500): a, c, t, g, unknown or other
  misc_feature (500)..(500): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagcgtggattttccttggtgctattttaaaagttgtccagtgtgaggtgcacctggtggagtcgggcggaggcttcgttaagccaggagggtccctaagactctcctgtgcagttctggattccctttcaatgtcgcctggatgaactgggtccgcaggctccaggggaagggactgggacgtggggttcgcccgcagttaaaaaggngaattgaatggacggganaacagactaacggcttacacccggttnaacggggtcagaatttccaccgtctccagngaatgattccaatgagtatcctagtctctacaatgaacngcctagacaaccgagacacagccgtntatactgacctactctcgaccacactggctacgtccacgaacgtattcgtacggggg

SEQ ID NO: 144016 - DNA, 554 bp, Homo sapiens
  misc_feature: GYAE6OF02GTCYD.35.87.H10.1.454.CMB.1.raw
  modified_base (417)..(417): a, c, t, g, unknown or other
  misc_feature (417)..(417): n is a, c, g, or t
  modified_base (450)..(450): a, c, t, g, unknown or other
  misc_feature (450)..(450): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagttctggattcccttcaatgtcgcctggatgaactgggtccgccaggctccgagggaagggactggagtgggttcgccgcgagttaaaaggagaattggatggcgggaacaacgagactacgcttcgacccgttcagggcagacttcaccgtcnccagagatgattccatgatatcctgtctactanaaatgaacagcctagaccaaccgagaaccacgacgccgtactattactgttaaccacgtctacgacccacacgtgacctactcaacgacgtattcgtacggggg

SEQ ID NO: 144017 - DNA, 1023 bp, Homo sapiens
  misc_feature: GYAE6OF02IUGZ8.35.87.H10.1.454.CMB.1.raw
tcagtacagatcgtcacgaccggtgctcgatttagcagtactgcgttgggtttggggagctctgggagaggagccccagccctttgggattccccaaagtgtttttactattcgtagtagtactcgtacgtactacgaaaccaacgaagggaacggtacctacccaacctaggtagggtttagggttttgggtcgtaggacgtcggttaggtttaccttttttccggtttggtcgttactttttaaaagtttttaaaagtttcgtacgttaggttggtaggtagggtcgaccgtacggttggggtagggtacggggtccggggacgggtacggttccgttttaacggttaaccgaccgggtaacggggttacccgggtttaaaccccgtaaaacggttacccttccccgttccggttggtccgtacgttttacggttttccggtacggtttacccctttttacccctttaactaacggttccgttcccggtccgttaggtaagtaacggtaaccgggttccgggtccccggtaccggaccggtccccggtaaccggggtaaagggggtaacggtacggtacgggtagggtttcgggtcccgcccgtaaggttaaaaggttaaaaggagttaagtaggtaggtacgggaacggaaaccaacggacgttaaccgtacccgttcgttaaccccgtaccggttaaccggacggtaccgtaaacgttaccgttaaccccgtaccggttacccgtaaaccggtaaggaacgttcgttaacgttaaccttaacgttacgtaacgttacgttaccgtttccgttccgttaccttaaccgtaaacttaaagtaccgaaaaccgtccgtaccgtaaacggaaacccgtaaaccggaaccgtaaccgacggtacccgtaccgttacttacgttaccgtaccgttaacctaccgttaccgaaccaactaacccgtgtaccgtaccgtaacgttacccgaaacgttaaccgttaccggttaccggggtacccgggg

SEQ ID NO: 144018 - DNA, 539 bp, Homo sapiens
  misc_feature: GYAE6OF02H34XB.35.87.H10.1.454.CMB.1.raw
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (477)..(477): a, c, t, g, unknown or other
  misc_feature (477)..(477): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcgggcggaggcttcgttaagccaggagggtccctaagactctcctgtgcagtttctggattccctttcaatgtcgcctggatgaactgggtccgccaggctccgaggggaaggctggagtgggttgcccgnattaaaaggngaattgatggcgggacaanagactacgcttaccacccgttcagggccagatttccaccgtctccgagagatgacttccatgagtatcctgtctactacaatgaacagcctagacacgagacacngcctatatactcgtaccactctacgaccacacgtgcacttcacgacgtattccgtacggggg

SEQ ID NO: 144019 - DNA, 705 bp, Homo sapiens
  misc_feature: GYAE6OF02F8BX7.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcacctggtggagtcgggcggaggcttcgttaagccagggaggtccctaagactctcctgtgctagttctggtattccctttcaatgtcgtcctggatgaactcgggtccgccaggcctccgaggggaacgggactgggaggtgggttcgcccggacgaagttaaaagggagtaattggagtgggacggggaactaaacgacggaacctacgaccgtttccgaaccccggtttacgaacggggcctaaggtactttccgacccggtttctacccgaaggagattcggtaactttcccaagttacggaagttacttccctggttaccttacgttaaacaaagttcgaaacacggacctaggaacccaaaccggacggaaccaacacgtaccgtacttaacgttaccttacgtaccctaccgttaccgtacggtaacccctaccgtaaccgtggtaaccctacgttacccgaacgaaccggttaacttcccgggtaacccggggggg

SEQ ID NO: 144020 - DNA, 691 bp, Homo sapiens
  misc_feature: GYAE6OF02IS09J.35.87.H10.1.454.CMB.1.raw
  modified_base (392)..(392): a, c, t, g, unknown or other
  misc_feature (392)..(392): n is a, c, g, or t
tcagtacagatcgtcacgaccggtgctcgatttagcagtactgcgttgggtttggggagctctgggagaggagccccagccttgggattcccaagtgtttcattcagtgatctggactgaacacagaggactcaccatggagtttgggctgagctggattttcctggtgctatttaaagtgtccagtgtgaggtgcacgtggtggagtcgggcggaggcttcgtaagcctagggagggtccctaaaggacctcgtcctggtgcgtagtttctggtacttcccctttcaattgtccgccttgggatgtaaccgtggggtacccgccgtaagggcctaccgaaggggaaacggctagggaacgttggggttcgccccgataagttaaaacgggngtaaagttgaagtcgggacgggaacaaacgaggaactaccggctttaccgaaccccgtttgaacggggctaaggtactttccgaaccggttcctacccgaagtacggtactaggtacttaccgagtacggtaagtactaccgtgtaccttactaacgaaatcgaactacgctacgaaccaaccggtagaaccacgtacgcccgtacttaatacccgtagtaccctacgtctaacgaccctaacgtcgtacggaacctaccgttactaaccggaaccgttagttccgggtaaccgggggg

SEQ ID NO: 144021 - DNA, 554 bp, Homo sapiens
  misc_feature: GYAE6OF02I1SGG.35.87.H10.1.454.CMB.1.raw
  modified_base (282)..(282): a, c, t, g, unknown or other
  misc_feature (282)..(282): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
tcagtacagatcgtcacgaccggtgctcgatttagcagtactgcgttggggtttggggagctctgggagaggagccccagccttgggattcccaagtgttttcattcagtgatctggactgaacacagaggactcaccatggagtttgggctgagctggatttccttggtgctattttaaaagttgtccagtgtgaggtgcacctggtggagtcgggcggaggcttcgttaagccagggagggtccctaagactctcctgtgcagtttctggattccctttnaatgtcgcctggatgaactgggtccgccaggctccgagggaggactggagtgggtgcccgcagttaaaaggagaattgatggacgggacaacgagactacgcttcaccgttcagggcagattcgacgtctccgagngatgattccatgatntcctgtctctacaatcgaacacgcctagacaaccgaagacacagccgtactattactcgtacctacgtctacgaccaacacgtggacctacttccgacgaacgtaacgttcggtacggggg

SEQ ID NO: 144022 - DNA, 584 bp, Homo sapiens
  misc_feature: GYAE6OF02HJU7E.35.87.H10.1.454.CMB.1.raw
  modified_base (357)..(357): a, c, t, g, unknown or other
  misc_feature (357)..(357): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagcgtggatttcctggtgctattttaaaagtgtccagtgtgaggtgcacctggtggagtcgggcggaggcttcgttaagccagggaggtccctaagactctcctgtgctagtttctggtattccctttcaatgtcgcctggatgaactgggtccgccaggctcccgagggaagggactgggagtgggttgcccgcattaaaaggngaatgatggcgggaacaacgagactacgcttcacccgttcgacggcagacttcacccgtctcccagagatgtacttccatgagtatcctgtctctaacaaatgaacacgctcgaccgaaccgaggaccacgacgaccgtactaccttactcgtaccctacgtcctacgtaccaacctacctggacctaccgttacaaccggtaccgtaacgttccggtaccgggggg

SEQ ID NO: 144023 - DNA, 599 bp, Homo sapiens
  misc_feature: GYAE6OF02IGYYH.35.87.H10.1.454.CMB.1.raw
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcacctggtggagtcgggcggaggcttcgttaagccgagggagggtaccctaagactctcctgtgctagtttctggactttcccttcaatcgtcgcctggatgaactgggtccncaggctccgagggaggctggagtggtnccganagtaaaggngaattgatggacggacaacgagactacgctacaccgttcagggcagtattcccaccgtctccgagatacgtgacttaccatggacttactccttcgtacttaccgtaacaaatagaaactcgaccctaggacccaaaccgagaaccacacgtaccgttctacttacgactacccgtatcctaccgacccaacgtaccgtcggtacctaccgttaccaacgtaaccgtacgttcggaccgggggg

SEQ ID NO: 144024 - DNA, 660 bp, Homo sapiens
  misc_feature: GYAE6OF02GUGC6.35.87.H10.1.454.CMB.1.raw
  modified_base (238)..(238): a, c, t, g, unknown or other
  misc_feature (238)..(238): n is a, c, g, or t
  modified_base (353)..(353): a, c, t, g, unknown or other
  misc_feature (353)..(353): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctatttaaagttgtcagtgtgaggtgcacctggtggagtcgggcggaggcttcgttagaaaaaaccngggaggtccctaaggactctccgtgtgcagtttctggtacttcccttcaatgtcgcctggatgaactgggtccgccaggcctccgagggaacggacgtggagtgggtcgcccganagttaaaacggagaagttgagtaggacggaacaacgaagactacgcttaccgaccgtacgacggcagtagttccaccgtctaccagacgtatgtacttaccagttacgaagttactaccgttgttacccgttactaaaccgtaaacgttacgaaacctacgtaccgtacgaaacccgtaaaccgacgggaacctacgaccggtaccctaacgtttaacgtaccgttacgtaaccctcctaccgtacaaccctacgtaccgtacgacctaccgttacgacccgtaacgtacgttccggtaaccggggg

SEQ ID NO: 144025 - DNA, 615 bp, Homo sapiens
  misc_feature: GYAE6OF02JAPHK.35.87.H10.1.454.CMB.1.raw
  modified_base (279)..(279): a, c, t, g, unknown or other
  misc_feature (279)..(279): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctatttaaagttgtccagtgtgaggtgcacctggtggagtcgggcggaggcttcgttaagccaggagggtccctaagactctcctgtgcagtttctggattccctttnaatgtcgcctggatgaactgggtccgccagggctccgaggggaagggactggaggtgggttcgcccggctaagttaaaagggacgaaagttggaatgggacggggacaaacgagaactacgcttccacccgttnacgggcagacttcaccgtcnccagagatgacttaccgatgaacgtatccttgtcttactaacaaattacgaacacgacctagaaccaacccggaaggactaaccgacggacccgtactacttacctacgtaaccctaacgttcctacgacccaactaccgtggacctaccgttaccacgtaaccgtagttccgtacgggggg

SEQ ID NO: 144026 - DNA, 572 bp, Homo sapiens
  misc_feature: GYAE6OF02ISMPA.35.87.H10.1.454.CMB.1.raw
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
  modified_base (462)..(462): a, c, t, g, unknown or other
  misc_feature (462)..(462): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcggggcggaggcttcgttaagccagggacgggtccctaagacctctcctgtcgctagtttctggtatttccctttcaatgtcgcctggatgaactgggtccncgaggctccgagggagggactggagtgggtgccgnataaaggngaattgagtggacggacaacgagactacgcttccaccgttnaggcagattcacgtcnccagagatgattccatgagtatcctgtctactaactaaatcgaaacncgacctagaaccaaccggagaaccacgaacgccgttactattacctcgtaaccctacgtctcacccacaccgtcgactacttccaacgtaacgtacgttcggtacggggg

SEQ ID NO: 144027 - DNA, 573 bp, Homo sapiens
  misc_feature: GYAE6OF02IGZUQ.35.87.H10.1.454.CMB.1.raw
  modified_base (404)..(404): a, c, t, g, unknown or other
  misc_feature (404)..(404): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagtgtccagtgtgaggtgcacctggtggagtcgggcggaggcttcgttaagccaggagggtcccctaagactctcctgtgcagtttctggattccctttcaatgtcgcctggatgaactgggtccgccagggcctccgaggggaagggacctggagtgggttgcccggcagttaaaagggagaagttgaagtggcggacaacagactacgcttacacccgttnacgggcagactcgaccgtctccagacgatgattccgatcggatactccttagtcctactacaaatcgaacacgcctagacaaccgaggacacagcctactagttacctctaccgtacctctcgaacccacactggactaccgttccaccgacgtaacgttcgacggggg

SEQ ID NO: 144028 - DNA, 594 bp, Homo sapiens
  misc_feature: GYAE6OF02F0C4M.35.87.H10.1.454.CMB.1.raw
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (392)..(392): a, c, t, g, unknown or other
  misc_feature (392)..(392): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattcccttnaatgtcgcctggatgactgggtccnccaggcctccgagggacggctggagtgggtgcccgntaagtaaaggngtaattgagtggcggacaacagactacgcttcacccgttnacgggcagtacttcaccgtctaccgagacgtatgacttccgagtgagtacttccgttgtccttactacaaatcgaactagcctaggaacctaaccggaggaccaccgacgtcccgttactacttacctacgtaccctacgttcaccgaacccaccgtacgtcggacctaccgttaccacgtacgtaacgttcggaccggggg

SEQ ID NO: 144029 - DNA, 582 bp, Homo sapiens
  misc_feature: GYAE6OF02FYDDJ.35.87.H10.1.454.CMB.1.raw
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (402)..(402): a, c, t, g, unknown or other
  misc_feature (402)..(402): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgttaggtgcacctggtggagtcgggcggaggcttcgttaagccaggagggtccctaagactctcctgtgcagtttctggattccctttcaatgtcgcctggatgaactgggtccgccaggctccgagggaggactggagtgggttcgcccgnaagttaaaacgggngaagttgagtggacgggacaacagactacgcttacacccgttnagggcagattccaccgtctccagagatgattccgatgagtactctgtctatacaaatnaacncacctagaaccgaaccgagacacgacgccgtactacttacgtactaccactcgtccaacctaccacgtcggacctaccttacgaaccgtaacgtacgttccggacgggggtacccggg

SEQ ID NO: 144030 - DNA, 543 bp, Homo sapiens
  misc_feature: GYAE6OF02GISX7.35.87.H10.1.454.CMB.1.raw
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (497)..(497): a, c, t, g, unknown or other
  misc_feature (497)..(497): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattccctttcaatgtcgcctggatgaacgtgggtccnccgaggctccgagggaggactggagtgggtgccgnattaaaaggngaattgatgggcgggacaacgagactacgcttcggacccgttnagggcagacgttcaccgtcnccagagntagattccatgagtatcctgtctactacaaatnaaacngacctagacaacgcgacacgagccgtactattactntaccactcagaccacacgtgactacttacgacgactagtgacgggg

SEQ ID NO: 144031 - DNA, 527 bp, Homo sapiens
  misc_feature: GYAE6OF02JEUOG.35.87.H10.1.454.CMB.1.raw
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (452)..(452): a, c, t, g, unknown or other
  misc_feature (452)..(452): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagttggggctgagctggattttccttggtgctattttaaaagttgtccagtgtgaggtgcacctggtgagtcgggcggaggcttcgttaagccaggagggtccctaagactctcctgtgcagttctggattccctttcaatgtcgcctggatgaactgggtccgccaggctccagggaggctggagtgggtgccgcattaaaggnggattgatggcggacaacngacacgcttcaccgtnagggcagattcacgtctcagagatgattccatgagtatcctgtctactacaatgaactagcctgacaacgngacacagccgtactattaccngtaccncgtctgacccatacctggcctacgttccacgacgtacttcgtacgggg

SEQ ID NO: 144032 - DNA, 540 bp, Homo sapiens
  misc_feature: GYAE6OF02II2VZ.35.87.H10.1.454.CMB.1.raw
  modified_base (303)..(303): a, c, t, g, unknown or other
  misc_feature (303)..(303): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (508)..(508): a, c, t, g, unknown or other
  misc_feature (508)..(508): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagcgtggatttcctggtgctattttaaagtgtccagtgtgaggtgcacctggtggagtcgggcggagcttcgttaagccaggagggtccctaagactctcctgtgcagtttctggattccctttcaatgtcgcctggatgaactgggtccncaggctccgagggaggctggagtgggtgcccgcagttaaaaggataagttgatggcggacaacagactacgcttcacccgttagacgggcagtacttcgaccgtctccagagatgattaccatgagttactcctgtctctaacaatgaaactgcctagaccaaccgagacacngcccgtntattactgtaccacgtcacaccacnctaggacacttcgacacgtacttcgaccgggg

SEQ ID NO: 144033 - DNA, 543 bp, Homo sapiens
  misc_feature: GYAE6OF02IDSMN.35.87.H10.1.454.CMB.1.raw
  modified_base (160)..(160): a, c, t, g, unknown or other
  misc_feature (160)..(160): n is a, c, g, or t
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagcggtgngttcctaggtcgctatttaaagtncagtgtgagtgnactgtgagcggnggaggctcgttaagccaggaggtccctaagactctcctgtgcagttctggacttcctttcaatgtgcctgatagacgtggtccncngctccgagggaaggctggagtggtnccgnataaagngatgnagcggacagagctanctacaccgtcagcganattcgacctacncgananatctatcatgtatacncttgtactacaanaananaacacacgacgacaacgaacgacgacgacgacgtactactacgtacgtaccgtacgtctacctaaccgaaccgtaaccgtacgtacgtacctaccgtaccgtaacgtaccgttaccggtaccggg

SEQ ID NO: 144034 - DNA, 558 bp, Homo sapiens
  misc_feature: GYAE6OF02HE116.35.87.H10.1.454.CMB.1.raw
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
  modified_base (460)..(460): a, c, t, g, unknown or other
  misc_feature (460)..(460): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcgggcggaggcttcgttaagccaggagggtccctaagacctctcctgtgcagtttctggattccctttcaatgtcgcctggatgaactgggtccgccaggcctccagggaagggactggagtgggttcgcccgnaattaaaacgggngaattgatggcggacaacgagactacgcttcacccgttnagggcagacttcaccgtctccagagatgatccagtgagtatcctgtctctacaaatcgaacngcctagaaccaaccggagacacgtacgaccgtctattaccagtaccactctacgaccactactgcctacgtaccacgtaacgtacgttcgtacggggg

SEQ ID NO: 144035 - DNA, 558 bp, Homo sapiens
  misc_feature: GYAE6OF02HI8NO.35.87.H10.1.454.CMB.1.raw
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
  modified_base (399)..(399): a, c, t, g, unknown or other
  misc_feature (399)..(399): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgctagtttcnggtattccctttnaatgtcgcctggatgaactgggtccncaggctccgagggaaggctggagtgggtcgcccgcaagttaaaaggngaagttgagtggcgggaacaacgagactacgcttcacccgttnagggcagatttccaccgtctccgagagatgacttcatgagtactcctgtctactaanaatgaacngcctagaccaacgagacacacgcctatattacctcgtacctatcctacaccactacgtgacctacttccgaaccgtactacgttcggacggggg

SEQ ID NO: 144036 - DNA, 697 bp, Homo sapiens
  misc_feature: GYAE6OF02HEUKI.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcacctggtggagtcgggcggaggcttcgttaagccaggacggtccctaagactctcctgtgctagtttctggactttccctttcaattgtccgcctggatgaactcgggtcccgccgtacggcctccgaggggaagggactgggaggttggggtcgcccggacgaagttaaaaggagtaagttgagtggacgggaacaacgagacgtacgcttacgacccgttcgagggcagtacttccaccgtctaccgagtagtatcgtacttccagttgaattactccctgttacccttacgtaaacaaattcgaaacgtacgtacccttaagaacccgtaaaccggacgggaacctaaccgtaaccgtacccgtttaacttaccgtttaaccgttaccgttaaccccgtaccgttaccgttacccgaacccacccgttaaccgtcgtaccctaaccgtttacaacccgggtaaccgttaacgttcccggggtaaccgggggg

SEQ ID NO: 144037 - DNA, 727 bp, Homo sapiens
  misc_feature: GYAE6OF02I1FM4.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcacctggtggagtcgggcggaggcttcgttaagccgaggacgggtccctaagacctctcctgtgctagtttctggtacttccctttcaattcgtccgcctggatggaacgtgggtcccgccgaggcctccggaggggaacgggacgtgggaggttcgggttcgcccgtacgtaaagttaaaagggagtaaagttggagtagggacgggaacaaacgacgacctacgccttaccgaacccgttcgacggggtacctaggtactttaccgacccgtttcctacccgaaggtacgtaacgttacgtactttaccaagttacggtaacgttacgttacccgttagtaccttacgttaaaccaaagttacgaaaccacggtaccctagaaacccgaaaccggacgaaccgaccgaacggtcccgttaacttacttaccgtacgtaacccaccgttcgtaaccgaaccctacctaacgtccggtacctaaccgttaccgaaccggtaaccgtacgttccgggtaccgggggg

SEQ ID NO: 144038 - DNA, 641 bp, Homo sapiens
  misc_feature: GYAE6OF02HXYLU.35.87.H10.1.454.CMB.1.raw
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagttctggattccctttcaatgtcgcctggatgactgggtccnccaggctccgagggaaggctggagtgggttcgcccgnagttaaaaggngtaagttggagtgggcgggaacaacgaggtacctacggcttccgaaccccggtttcgaaggggccaggactttccgaacccggttctcccgaagacggtatcggaactttccgaattaggacgttaattccctagttcctctaaaccgaaattggaaacctgaccctagaaccaaaccggtaggaaccacacggtccctatactacgtcgtaaccctactctacgacctaccgtaacctcggtacctaccgttacaacccggtacgtaacttccggtaccggggggg

SEQ ID NO: 144039 - DNA, 623 bp, Homo sapiens
  misc_feature: GYAE6OF02ITS2N.35.87.H10.1.454.CMB.1.raw
  modified_base (452)..(452): a, c, t, g, unknown or other
  misc_feature (452)..(452): n is a, c, g, or t
  modified_base (497)..(497): a, c, t, g, unknown or other
  misc_feature (497)..(497): n is a, c, g, or t
  modified_base (587)..(587): a, c, t, g, unknown or other
  misc_feature (587)..(587): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcgggcggaggcttcgttaagccagggagggtcccctaagacctctcctgtgctagttctggatttccctttcaatgttcgcctggactgaactggggtccgccgacgggtcctaccgaggggaacgggacgtgggacggtggggttcgcccggctaagtttaaaaacgggagaattaggagtgggacgggaacaaacgagaactacgcttaccgacccgttcgagggcagcttcaccgtntcccagagatgacttccagtgagttactccgttgtcttccgtaanaaacgtcgaaacctagccgttacgaacctaaaccgggacgtaacaccgtacgaccctatacgttactcgaaccctagtcctagacccacncgtagaccctatccacgtacgagttcggtaccgggg

SEQ ID NO: 144040 - DNA, 602 bp, Homo sapiens
  misc_feature: GYAE6OF02GGCCR.35.87.H10.1.454.CMB.1.raw
  modified_base (284)..(284): a, c, t, g, unknown or other
  misc_feature (284)..(284): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (563)..(563): a, c, t, g, unknown or other
  misc_feature (563)..(563): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcggtaagccaggagggtcctaagactctcctgtgctagttctggactttcccctttanaattgtccgtccgtaggatgaacgtgggtcccnccaggctccgaggggaacggactgggagttggggtcncccgagtaagttaaaaggngtaagttgagtggacggaacaacagactacgcttcacccgtgaggcagtacttcaccgtctacagagatacgattccagtgatactcttagtctctaaacaaatcgaaactcgacctaacgaaccgaaaccggtacggaaccacgacgtaccgttatacgtacttacgaacctccgtactacaaccgacnccgtacgacctctaccgacctacgtacgtcggtacgggg

SEQ ID NO: 144041 - DNA, 660 bp, Homo sapiens
  misc_feature: GYAE6OF02IF1VX.35.87.H10.1.454.CMB.1.raw
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttaattttaaaagttgtccagtgtgaggtgcaccgtggtggagtcggggcggaggtcttcggttaagccgagggacgggtccctaaagacctctcctgtgctagtttctggtacttccctttnaatgtcgcctggatgaacgtgggtcnccgaggcctccgagggaaggctggagtgggtcgccgntaagttaaaaggagtaagttgagtggacggacaacgagactacgctcgacccgttcgacggacagtactcgaccgtctcgagacgtatgtaacttccaagtcgtacgttatccgttgtactactaaacaaagttcgaaacctacgcctacgaacccgaaaccggtaacggaaccaacgaaccgtccgttaaccttaattaaccgtcgtaaccctacgtaccgtaccgaaaccctaccgaaccgttacggtacctaaccgttaccgaaccggtaaacgttaccgttcgggtaacccgggggg

SEQ ID NO: 144042 - DNA, 687 bp, Homo sapiens
  misc_feature: GYAE6OF02GPNG6.35.87.H10.1.454.CMB.1.raw
tcagtacagatcgtcacgaccggtgctcgatttagcagtactgcgttggggtttgggggagctctggggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcgggcggaggcttcgttaagccagggagggtccctaagactctcctgtgctagtttctggactttccctttcaatgtccgtcctggtactgaacgtcggggtcccaccgagggtcctaccgaaggggaacggggtacgtaggggaggttcggggttcgcccggtacgaaacgttaaaacgggagtaaagtttggagtcgggacgggaactaaacgagaacctacgcttaccgacccggttcgaagggccaggtactttaccgacccgttctacccgaggaacgatgtaacttccagttcggaagttacgtccttgtacctactaacaaatacgaactcgacctagaacctaaccgggagaaccacgacgtccgtacttagtacctacgtaaccctctaccgtacggaaccccacgtacccgtagaccttaccttccgaaccgttaacggtaacttccgggtaacccgggggg

SEQ ID NO: 144043 - DNA, 862 bp, Homo sapiens
  misc_feature: GYAE6OF02ITYCM.35.87.H10.1.454.CMB.1.raw
tcagtacagatcgtcacgaccggtgctcgatttagcagtactgcgttgggtttgggggagctctgggagaggagccccagccttgggattcccaagtgttttcattcagtgatctggactgaacacagaggactcaccatggagttggggctgagctggattttccttggtgcttattttaaaagttgtccagtgtgaggtgcacctggtggagtcgggcggaggcttcgtaagccagggagggtccctaaggacctactcctgtgctagtttcgtaggtactttccctttacaagttcgtccgccttggattaggtaaccgttggggtaccccgccgaacgggtccttacccggaaagggggtaacggggaccgtaggggaaggttcgggggttcgaccccggacgtaaaagtttaaaaacgggagtaaagtttaggaagttacgggaccggggaactaaaacgacgtaaccgtacggtacctttaccgaaccccgtttacgaacggggtccgaaagtaccgtttacccgtaaacccgtttccgtacccgaaagggtaaggtaacttacggtaactttccccgaaaggtttacggtaaacggttaaccgttacccttggtttaacccttacctaaaactaaacgggttacaaaccggtagtacccggttaaacgaaccggtaaaacccggacggaaccaccggtaaaccggtccccggttaaacccttaagttttaaaccccgtcggttaaaaccccctacggtttaccctaacggaaacccctaaccgttaaaccgttccggaacctacccggtttacccaaccgggttaaacctaaccggttacgggttaaccgggggg

SEQ ID NO: 144044 - DNA, 683 bp, Homo sapiens
  misc_feature: GYAE6OF02JCYYJ.35.87.H10.1.454.CMB.1.raw
  modified_base (352)..(352): a, c, t, g, unknown or other
  misc_feature (352)..(352): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccgtggtgtcttaattttaaaggttgtccagtgtgaggtgcacgtggtggagtcgggcggaggcttacgttaagccgaagggacggtcccctaaaggacctcgtcctggtcgcctagtttctggtacttccctttcaatgtcgccgtggatgaacgtgggtccgccgaggctccgagggaggacgtggnggtgggttcgcccgagaagtaaacggagtaatggagtcggagggaacaacgagacgtacgcgttaccgaccgtcgagggacagtactacgccgtacacgagagactgtactacgatgtacgtactcgtagttcctacgtaactaagtaacgaacgtaaccgtcgtacgaaccgaaaccggaagaacccgtaaccgtaccgtaccgttaaccttaacgtttaaccgtaccgttaaccccgtacgttacgtacccgtaacgtaaccgaaccggttcgaacccgttaaccgtttaccgaaccggtaaccgttacgttaccgggtaacccggggg

SEQ ID NO: 144045 - DNA, 587 bp, Homo sapiens
  misc_feature: GYAE6OF02H3DXB.35.87.H10.1.454.CMB.1.raw
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (443)..(443): a, c, t, g, unknown or other
  misc_feature (443)..(443): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (504)..(504): a, c, t, g, unknown or other
  misc_feature (504)..(504): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcactggtggagtcgggcggaggcttcgttaagccagggagggtccctaagacctctcctgtgctagtttctggtactttcccttanaatcgtcgcctggntgactgggtccncaggctcgagggacggntgggagtgggtcgccgntaagttaaaggagtaagttgagtggacgggaacaacgagacctacgcttaccgtacccgtcgagggcacgtacttccgaccgttctaccgaagagtntacgtacttcagtagtacgtactcctagtctactanaatacaancncgacgtaccgaacgngacacacgtacctctatacgtactacctactactcgacaaccgtcttagacctactacgaacgtacgtagttccggaacgggg

SEQ ID NO: 144046 - DNA, 586 bp, Homo sapiens
  misc_feature: GYAE6OF02JQNWC.35.87.H10.1.454.CMB.1.raw
  modified_base (270)..(270): a, c, t, g, unknown or other
  misc_feature (270)..(270): n is a, c, g, or t
tcagtacagatcgtcacgaccggtgctcgatttagcagtactgcgttggggtttgggggagctctgggagaggagccccagccttgggattcccaagtgttttcattcagtgatctggactgaacacagaggactcaccatggagtttgggctgagctggattttcctggtgctatttaaaagttgtccagtgtgaggtgcacctggtggagtcgggcggaggcttcgttaagccaggagggtccctaaggactctcctgtgcagtttcnggattccttcaatgtcgcctgatgaactggtccgccaggctccgagggaaggacgtggagtgggttgcccgcaagtaaaggagaatgagtggcggacacaaaagctaagctcaccgtcaggcagatcacgtctaccagagatgacttccatgagtactctgtctactacaaatgaacagtcctagacctaaaccgacggaaccacgacgtcccgtaacttacttaccgtacgtaaccctacgtcctacgaaccctaaccgtaacgtccggtacctacctttaccgaaccgtaccgtaacgttccggtaaccggggg

SEQ ID NO: 144047 - DNA, 674 bp, Homo sapiens
  misc_feature: GYAE6OF02H8Q4I.35.87.H10.1.454.CMB.1.raw
  modified_base (350)..(350): a, c, t, g, unknown or other
  misc_feature (350)..(350): n is a, c, g, or t
  modified_base (566)..(566): a, c, t, g, unknown or other
  misc_feature (566)..(566): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaagttgtccagtgtgaggtgcacctggtggagtcgggcggaggcgttcgttaagccaggacggtccctaaggactcgtcctgtgctagtttctggtacttccttcaatgtcgcctggatgacgttggccgccgaggtcctccgaggaaggactggacgtgggtcgacccggngtaacgttaaaaggacgtaagttcgaaggtcggacgggaacaacgtaacgacgtacgtacttaccgtaccccgttagaacgggactaggactttcgaccgtcgtaccgtagaacgtactacggtacttccaacgtcgtaaacgttaactccttcgttcctaacttaaacgaaacttcggaaacctcgacccgttagaaccgaaacggacgtaaccncgtaacggccgttaagtactttaccgtagtacccaacgttctaacggaccctaacgaccgttcgacttaccgttaccgaaccgtacgtaacgttcggtaacccggggg

SEQ ID NO: 144048 - DNA, 646 bp, Homo sapiens
  misc_feature: GYAE6OF02HOT4T.35.87.H10.1.454.CMB.1.raw
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
tcagtacagatcgtcacgaccggtgctcgatttagcagtactgcgttgggtttgggagctccgggagaggagccccagccttgggattcccaagtgttttcattcagtgatctggactgaacacagaggactcaccatggagtttgggctgagctggattttccttggtgctattttaaaagtgtccagtgtgaggtgcacctggtggagtcgggcggaggcttcgttaagccaggagggtccctaagactctcctgtgcagtttctggattccctttnaatgtcgcctggatgaactggtccnccgagctccgagggaggctggagtggtcnccgnaagttaaaaggntaatgaagtggacggactaacagactacgctaccgacccgttgacggcaaggtacttcgaccgtcctaccgagtacgagtagacttaccgaatcggaacgtactccgttacgttccgttactaagtaaacttgaaacctacgtacgtacggaaccaaaccggaacggaaccaccgaacggtaccctacgtaacttaccgtacgtacccgtacttacccgtacgtaacctacgtaccgtacggtaccaccgtttaccgaaaccgtaacgtaacgtttccgggtagggtaaccccgggg

SEQ ID NO: 144049 - DNA, 547 bp, Homo sapiens
  misc_feature: GYAE6OF02F3CX4.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaagttgtccagtgtgaggtgcacctggtggagtcgggcggaggcttcgttaagccaggagggtccctaagactctcctgtgcagtttctggattccctttcaatgtcgcctggatgaactgggtccgccaggctccgagggaagggactgggagtgggttgccgcattaaaaggagaattgatggacgggacaacagactacgcttcacccgttcagggcagacttcaccgtctccagagatgatccatgagtactctgtctctacaatcgaacagcctagacaaccgagacacgacgccgtactactactcgtaccactcacgaccacactggactaccttacgaccgacgtacgttcgtacggggg

SEQ ID NO: 144050 - DNA, 732 bp, Homo sapiens
  misc_feature: GYAE6OF02G5EXY.35.87.H10.1.454.CMB.1.raw
  modified_base (654)..(654): a, c, t, g, unknown or other
  misc_feature (654)..(654): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggacgtcgggcggaggtcttcggttaagccagggagggtccctaagactcctaccgtgtgctagtttctggtacttccctttacaactcggtccgtcctgggacttgtaaccgttggggtcccgcccaagggccttccggaaggggaacggggaccttaggggacgttggggttacgccccggtacaaggtttaaaacggagtaattaggacgttaggacgggaacaaacgaggaccttaacgctttaccgaccccgttcgaacgggtcaacgtactttaccgacccgtactcccgaaggagtatacggtacttcccgaagttcgtaacgttaaccttccggtacgttcctaacttaacgaaaactcggtaaacctaacggtcccttaaggaacccgtaaaaccgacgggtaaccaacgaacgtaccggtaccttaagttacccgngttaacccacgttaccgacgtaccccaagaccgttggacctaccttacgtaccggtaactacgtttcggtaccggggg

SEQ ID NO: 144051 - DNA, 651 bp, Homo sapiens
  misc_feature: GYAE6OF02FIINH.35.87.H10.1.454.CMB.1.raw
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaagtgtccagtgtgaggtgcacctggtggagtcgggcggaggcttcgttaagccagggacgggtccctaagactctcctgtgctagtttctggacttcccttnaacttgtcgcctggatgaactcgggtccnccgaggcctcgaggggaacggcnggaggtgggttcgcccgngtaagttaaaagggagaattggagtgggacgggacaacgagactacgcttaccgacccgttacgacgggcagtacttccaccggttctaccgagacgaattcgacttcccgaattcggaagttacttcccgttgtacctactaacaaattgaaaccttacgcctagaaccgaaccgtaggaccaacgacgtcccgttacgtattaccgtacgtaccctacgtcgtaccggaacccctacgtaaccgtcggtacctacccgttaccgaacggtacctaacggttcccggtaaccgggggg

SEQ ID NO: 144052 - DNA, 592 bp, Homo sapiens
  misc_feature: GYAE6OF02GUIDB.35.87.H10.1.454.CMB.1.raw
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcgggcggaggcttcgttaagccagggagggtccctaagactctcctgtgctagtttctggtattccctttnaatgtcgcctggatgacgtgggtcccccgaggctccgagggaaggctgggagtgggttcgcccgctaagttaaaagggngtaattgagtggcgggacaacagactacgcttccacccgttcaggcagtactcaccgtcacgagagatgacttccatgactactctgtcctactaacaagtcaactcgacctagaccaaccggagaaccacacggcccttacgtacttaccgtcgtaccctacgttacctacgaacccacgtacctggaccctacgttaccgaacggtacgtaacgttcggtaccggggg

SEQ ID NO: 144053 - DNA, 572 bp, Homo sapiens
  misc_feature: GYAE6OF02FLVLZ.35.87.H10.1.454.CMB.1.raw
  modified_base (305)..(305): a, c, t, g, unknown or other
  misc_feature (305)..(305): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaagttgtccagtgtgaggtgcacctggtggagtcgggcggaggcttcgttaagccaggagggtccctaagactctcctgtgcagtttctggattccctttcaatgtcgcctggatgaactgggtccnccaggcctcgaggggaacgggctgggaggttgggttgcccggcaagttaaaaggngtaattgatgggacggacaacgngactacgcttacgaccgttcagggcagatcgaccgtctccagngatgtactcatcgagtactcctgtcctactaacaaatgaaccagcctagaccaacgngaaccanacgcctacgtactacgttcgacctactcacgacccacaccgtcgactaccgttaccgaacgctaacgttcggtaaccggggg

SEQ ID NO: 144054 - DNA, 607 bp, Homo sapiens
  misc_feature: GYAE6OF02HNYMC.35.87.H10.1.454.CMB.1.raw
  modified_base (284)..(284): a, c, t, g, unknown or other
  misc_feature (284)..(284): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
  modified_base (480)..(480): a, c, t, g, unknown or other
  misc_feature (480)..(480): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcacctggtggagtcgggcggaggcttcgttaagccgaggagggtccctaagactctcctgtgctagtttctggattccctttnaatgtcgcctggatgaacgtgggtccgccaggctccgagggaagggctggagtgggttcgcccgctaagttaaaaggagaattgagtaggacgggacaacgagactacgctcgacccgttnaggcaagtatcgaccgtntccaagcgtatgacttccgaatcgagttatccttagtcctctaaacaaattgaaacngcctacgaaccgaaaccgacggaacaccgacggacctaacgtattaccgtacgtacctaccgtctacgaaccaccaaccgtgggaccctacgttacccaaccggtaacgtacgttcggtaccggggg

SEQ ID NO: 144055 - DNA, 581 bp, Homo sapiens
  misc_feature: GYAE6OF02F9FFS.35.87.H10.1.454.CMB.1.raw
  modified_base (284)..(284): a, c, t, g, unknown or other
  misc_feature (284)..(284): n is a, c, g, or t
  modified_base (365)..(365): a, c, t, g, unknown or other
  misc_feature (365)..(365): n is a, c, g, or t
  modified_base (437)..(437): a, c, t, g, unknown or other
  misc_feature (437)..(437): n is a, c, g, or t
  modified_base (481)..(481): a, c, t, g, unknown or other
  misc_feature (481)..(481): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgctagtttctggactttccctttnaatgtcgcctggatgaactgggtcccgccaggctccgaggggaacgggctgggagtgggtcgcccgactaagttaaaaggngtaattggagttggacgggacaagcgactacgcttcacccgttgacgggcagtacttcaccgtctaccaganatgacttccagtgagtactccttgtctactaactaaatcgaacngacctacgaaccgaccgaggacacgacgcctactactactcgacctactcgacacccacaccgtcgtacaccttcaacgtacgtacgttccggtacgggg

SEQ ID NO: 144056 - DNA, 657 bp, Homo sapiens
  misc_feature: GYAE6OF02FY1TC.35.87.H10.1.454.CMB.1.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (501)..(501): a, c, t, g, unknown or other
  misc_feature (501)..(501): n is a, c, g, or t
  modified_base (549)..(549): a, c, t, g, unknown or other
  misc_feature (549)..(549): n is a, c, g, or t
tcagtacagatcgtcacgaccggtgctcgatttagcagtactgcgttgggtttggggagctcctgggagaggagccccagccttgggattcccaagtgttttcattcagtgatctggactgaacacagagactcaccatggagtttgggtctgagctggtattttccttggtgcttatttaaagttgtcagtgtgaggtgcacgtggtggagtcgggcggaggtcgttcgttaagccagggacggtccctaagactcgtcctgtgctagtttctggactttcccctttnaatgtcgcctggntgaactgggtccnccaggctccgagggagggctggagtgggtcgcccgngtaagttaaaggngtatgagtggacggganaacgagtactacgtctcacccgttgacgggctaggactttcgacccgttctacccaggacgtataggtaccttaccaagtcggaactattccttagtacctttacaactaaatcgaaacncgtaccgtacgtaccgaaccgtaaggtaccaacgtacgtaccccgttnttaaccgttaccgtacggaaccccgtattccggtaccggtaacccaaccgtaaccggtactcctacccgtacggacccgtaagttaccggttaccgggtacccggggg

SEQ ID NO: 144057 - DNA, 706 bp, Homo sapiens
  misc_feature: GYAE6OF02I0CHF.35.87.H10.1.454.CMB.1.raw
  modified_base (332)..(332): a, c, t, g, unknown or other
  misc_feature (332)..(332): n is a, c, g, or t
  modified_base (375)..(375): a, c, t, g, unknown or other
  misc_feature (375)..(375): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgtcttaatttttaaaagttgtaccagtgtgaggtgcacctggtggaggtcgggcggaggctttcggttaagccgaagggacgggtaccctaaagaccttcctccgtgtgctagtttctggatttccctttacaatcgtcgcctggatgaacgtcgggtccnccaggctccgaggggaagggactgggaggtgggttcgcccganaagttaaaaggagaagttgagtcggcggaacaacgagactacgcttaccgacccgttacgagggcctaagactttcgaacccgttctacccaggaagtactcggtacttaccgagttcggtaacgttattcccgtttgtaccctttactaaaacctaaagttacaaaaccctgacccgttaacgaaaccggaaaccgacggtaaaccgaccgtaacgtccccgttaattaacgttaacctacgtaaccctaccgtcctaccgaccctaaccgtacgtaccggacctaacccgttaccaacggaaccgttagttacccgggtaccggggggg

SEQ ID NO: 144058 - DNA, 704 bp, Homo sapiens
  misc_feature: GYAE6OF02HVI3V.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctatttaaaagttgtcagtgtgaggtgcacctggtggagtcgggcggaggcttcgtaagccgaggagggtccctaagactctcctgtgctagtttctggtacttccctttcaatcgtacgtccgtggatagaactgggtcccgccgacggccgtccgaggggaacggggacgtgggaggtggggtcgcccggacgtaagttaaaaagggagtaaagttggaagtaggcggggtaaccaacgaacgaccgtacgcttaccgacccgttcgacgggcagtactccgaccggtctacccgagacagtacgtacttaccgatggtaagttactccgttacgttccttaaccttaacgaaaagtacgaaacacggtcccctaaggaacccgaaaccggaacggaaccaaccgaaccgtacccggttaacttacgttaaccttacggtaaccctaacgtccgtaaccgtacccgaacctaacgttccgacctaaccgttaccgaacccgtaaccgttacggttccggtaacccgggggg

SEQ ID NO: 144059 - DNA, 637 bp, Homo sapiens
  misc_feature: GYAE6OF02J0X5A.35.87.H10.1.454.CMB.1.raw
  modified_base (348)..(348): a, c, t, g, unknown or other
  misc_feature (348)..(348): n is a, c, g, or t
tcagtacagatcgtcacgaccggtgctcgatttagcagtactgcgttgggtttggggagctccgggagaggagccccagccttgggattcccaagtgttttcattcagtgatctggactgaacacagaggactcaccatggagtttgggctgagctggatttcctggtgctattttaaagtgtccagtgtgaggtgcacctggtggagtcgggcggaggcttcgttaagccgaggacgggtccctaagacctctcctgtgctagtttctggacttcccttacatcgtcgcctggatgaacgtcgggtccgcaggctaccggagggaacggctggaggtggtcgccganaagtaaaggagtagtgagtggacggacaacgagactacgctacgaccgttcgaggtccaggtacttccgaccgtcaccgaagtacgtatgacttccagtagtacgttactcctaggttctacctaacgaacgtacgaacctacgtaccgtagaaccgaacgtacgaacgacgaccgttccgtaacttacgttaaccgtacgtaccctacgtaccgtacgtaaccctacgtacgtccggtaactaccgttaccgaacgtacccgtacggttaccggccggggttaacccg

SEQ ID NO: 144060 - DNA, 678 bp, Homo sapiens
  misc_feature: GYAE6OF02GI71Z.35.87.H10.1.454.CMB.1.raw
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
  modified_base (570)..(570): a, c, t, g, unknown or other
  misc_feature (570)..(570): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaagttgtccagtgtgaggtgcacctggtggagtcgggcggaggcttcggttaacgccgagggacgggtcccctaagacctctcctgtgcagtttctggacttccccttanaagttcgtcgtcctgggatgaacgtgggtcccgccgaggcctacgaaggggaacgggactgggagtggggtcgcccggtanaagttaaaggacgtaagttggagtgggacgggtacaaacgagaaccgtacgcgttacctacccggttacgaaggggccaaggtactttaccgaccggtcctacccgaagtacgtatcgtaacttcctagtacgacgttacgttccttggttacccttacttaacaaagtcaaacgtacgtcctaagaacccgtaaaccgngaaacctaacgacgtacccgttaccgtaattacccgtacgtaaccctacgttccacgaccctacacgtcgaccaccttaccgacgtaacggtacttccgggtacgggg

SEQ ID NO: 144061 - DNA, 800 bp, Homo sapiens
  misc_feature: GYAE6OF02JAY74.35.87.H10.1.454.CMB.1.raw
  modified_base (196)..(196): a, c, t, g, unknown or other
  misc_feature (196)..(196): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccaatggagtttgggctgagcgtggtttctgttagccatttaaagtgtcagtgtgagtgcngctggtggagtccgggggagcttagtgacgccgtgggggtcctgagactctcctgtagcacgcacgtgattcaccttnagtagtcacgtggancgtacagtcgggtacctcgtaaggttcccgaaggggtacggggtacgtgggtcggttacggttttacgaaccggttaagttaacggtagttacgaaggtacgggtactaacggaaactaaaccgtaaaagtttacccgtaacggtaacccggtaaccgttaccccgggttaagggtaaaacccggggtacccggttaaaccttcccccgtaaacccccccgtaacccgtaaacgggtaaaccggtaaacccgaaaacccggaaaccccgtaaaacggaaaacccaaaccgttaaacctaaaccgtaactaaccgttaacgaaacaaaacgtacgtaaacctaacgttaccgtaacgtacggaacccggacgaaaccgggaaccgtaaccggaccgtttacggtacttaaacgtaaccgttagtacgtaaccgtaaagggtacgggtacgaacgtaacgtaactacgttaacgtttaggttagtaacgttcgttacgggaccgggtaaccgg

SEQ ID NO: 144062 - DNA, 674 bp, Homo sapiens
  misc_feature: GYAE6OF02JFQ3P.35.87.H10.1.454.CMB.1.raw
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
tcagtacagatcgtcacgaccggtgctcgatttagcagtactgcgttgggtttgggggaggctctgggagaggagccccagccttgggattcccaagtgttttcattcagtgatctggactgaacacagaggactcaccatggagtttgggctgagctggattttctggtgctattttaaaagttgtccagtgtgaggtgcacctggtggagtcgggcggaggcttcgtaagccaggagggtccctaagactctcctgtncagtttcnggtnttccttcaactgtcgtctgatgtaacgtgggtccnccgtagggcctaccgaggggaacgggacgtgggacggttgggttcgcccggagtagttaaaagggcgtaaagttggagtgggacggggtaccaaagaacggtaactacggtccgttaccgtaccccgtttacgacggggactaacggtactttcccgacccgggtccttacccgaaggtacgactacgacgtttccagtgtacgtactcccgtgttacccttactaacaatacggtaacacgaccgtcgaaaccaaccgggacgtaccaaccgagtccccgtatacgtttaaccgcggttaacctacggtccttaagaccctaccaggttcgacctacttccggaactaagtaccttcggtacgggg

SEQ ID NO: 144063 - DNA, 728 bp, Homo sapiens
  misc_feature: GYAE6OF02IQPA4.35.87.H10.1.454.CMB.1.raw
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
  modified_base (528)..(528): a, c, t, g, unknown or other
  misc_feature (528)..(528): n is a, c, g, or t
tcagtacagatcgtcacgaccggtgctcgatttagcagtactgcgttggggtttgggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccgaggagggtccctaaggacctctcctggtnctagtttctggtattccctttnaatgtcgcctggatgaactgggtccgccaggctccaggggaagggacgtggagttgggttcgccccgngtaacgttaaaagggagtaagttgaagtggacgggtaacaacgagactacgcttaccgacccgttcgagggcagactttcgacccgtctcccgaaggacgagtacggtacttccgaattgtaacggttaattcccgttgttaccttacttaaacgaaaacttcggaaaccncgtaacccgtacgtaaacccgaaacccggtaagggaaccaacccggtaaggtccccgtttaacgttaacgtttaaccgttaccgttaacccgtaaccgttccgttaacccggaacccttaacccgtaaccgttcggaccctttaaccctacccgtaaaccggtaaacccgttaacggtttcccggtaacccggggggggg

SEQ ID NO: 144064 - DNA, 897 bp, Homo sapiens
  misc_feature: GYAE6OF02GXJE0.35.87.H10.1.454.CMB.1.raw
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggtattttccttggtgtcttattttaaagttgtccagtgtgaggtgcacctggtggaggtcgggcggaggtcttcgttaacgccgaagggacgggttacccaagacctcctcctggtgtctagttttcctggtactttcccgtttcaatcggtccgccgttggattcggtaaaccgttcgggtccccgaccgacggcccgttacccggaagggggaaaccgggtacgttaggggaacgggttcggggtttaccggaccccgtaacgttaaaaggtttaaaaacgggaaggttaaacgtttaggaaggtacggggaaccggggtaaacaaacggtacggtaaacccgtttacggaccccttttaccggaacccccggtttacgaacgggggtaccctaaaacggtaccgttttaacccgtaacccccggtttccgtacccgaacgggtaaacggtaacgtacgttaaaccgttaccgtaaggtaacgttaacggttaaccttccgttacgttaaccctttaacgtaaaccgtaaaacgttaccggaaaactacccgttaacccgttaactaaaccccggaaaacccggacggtaaacccaaccgtaaaccggttccttaaaccctttacgtttaacccgttcgtaaaccccgttactccccgttaacgaacccctaacgttacccgtaggacccttaccttaccggaaaccggtacgttaccggttacgggtaaccggggg

SEQ ID NO: 144065 - DNA, 707 bp, Homo sapiens
  misc_feature: GYAE6OF02F12QX.35.87.H10.1.454.CMB.1.raw
  modified_base (336)..(336): a, c, t, g, unknown or other
  misc_feature (336)..(336): n is a, c, g, or t
tcagtacagatcgtcacgaccggtgctcgatttagcagtactgcgttgggtttggggagctcgtgggagaggagccccagccttgggattcccaagtgtttcattcagtgatctggactgaacacagaggactcaccatggagtttgggctgagctggattttcctggtgcttatttaaagtgtccagtgtgaggtgcactggtggagtcgggcggtagcttcggttaagccaggtacgggtccctaagactctacctgtcgctagttttcgtaggtactttcccctttagaactggtccgtccttagggacttacggtaacgttggggttacccnccgtaaggccttaccggaagggtaacggggtacctgggaacggttcgggttcgcccgtagtaaagttaaaacggagtaagttggagttgggacggaactaaacgaggtaacctacgccttacgaccccggttagaacggtaccaggtactccgaccgtcgtaccaaggtacgatcgtacttccgagtacgagttactacgtagtcctaactaacgtaaactacgaaaccgtacgtacccgtaagaacccgaaacggtaacgacgtaaccacgggtacctacgttaacgttacgtaccgtaaccgtcgtaactccgaaccacgtcgaccggactaacgtaccgaacgtacgtaaccggttggtaacccgggg

SEQ ID NO: 144066 - DNA, 745 bp, Homo sapiens
  misc_feature: GYAE6OF02I9YOI.35.87.H10.1.454.CMB.1.raw
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgtctattttaaaagtgtccagtgtgaggtgcacctggtggagtcgggcggaggtcgttacgtaagccgagggtacgggtccctaagactctccttgcgctacgtttctaggtacttccctttanaatgtccgccgtggnttcgaactgggtccgccgacggtcctccgaaggggtaacggacgtcgggtaggttcgggttcggaccccgtagtaaacgtttaaaaagggcgttaaagttggaagtcgggaccgggaactaaacgaacggtaaccgtaacggtaccgtttaccgtaaccccggttcgtaacggggtaccgtaaggttaacgtttaccacccggttacctaccggaagtaacggactacgtaacgttccaagttacggtaagttcttaccgttagttccttaaccgtaaccgtaaatccggaaacgtcctaaccggtaccgaaacgaaaccggaccgaactaaccgtacgtaccgaccgttaacttacgtaccgtacccacgttcgaccgtaccaacgtcgtacgtaccgaacttccgaacgtaaccgtaccgttcgggtaaccgggg

SEQ ID NO: 144067 - DNA, 769 bp, Homo sapiens
  misc_feature: GYAE6OF02HMQRQ.35.87.H10.1.454.CMB.1.raw
  modified_base (312)..(312): a, c, t, g, unknown or other
  misc_feature (312)..(312): n is a, c, g, or t
  modified_base (607)..(607): a, c, t, g, unknown or other
  misc_feature (607)..(607): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgcttattttaaagttgtccagtgtgagtgcacgtggtggaggtcgggcggaggtctttacggtaacggccgaagggtacgggtacccgtaaagaccttctccgtgtacgtccgtagttttcgtaggtacctttcccgttttanaagttcgtaccgtccgtggattacggaaccgttcggggtacccgtccgaagggtcctacccggaagggggtaacgggacgttaggggtacggttcggggtttccgccccggaagtaaagttaaaacgggagtaaaggtttcggaagtagggacgggaaccaaacggaacacgttaaccgccttacctacccgggttacgaggggactacgtacgtttacccaccggttcccaccgaggaactagttacgactttaccgagtttacgacttacttccgttcgtaccttacttaaanaacttaggaaaccttggaacctagaacccgaaacgggagtaaccgaagtaccggtccttaacgtaccgtttagacccttaacctaccggttccacgttaaccccgataccgtcggaccttaacgtacccgaaaccgtaacgttacggtcccgggtacggggg

SEQ ID NO: 144068 - DNA, 710 bp, Homo sapiens
  misc_feature: GYAE6OF02JUMUK.35.87.H10.1.454.CMB.1.raw
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttcctggtgtctaattttaaagttgtcctagtgtgaggtgcactggtggagtcgggcggaggtcttcgtaagccgaggacggtcctaagactctcctgtcgctagtttccgaggtctttcccttnaatggtcnccgtggatgacgtggccncgagctcggagggaggtctggaggtcggtcgccgactaaggttaaaggagtaagttcgaggtcggacgggaactaagacgtactacggtcttaccgtacccggtagacgggacctactacggttccaaccgggttccacctaagggacgttaagtacgtaccgttacgacgttaacgacggtttacctcgttcgttaccttaaacttaacggaaattccggaaacgtccggtaccttaacggaaaccgtaaaccccggagtaaaccgaccgtaaccggttcccgttaaactacgttaccggttaccgtaccgtaacccgtcgttaaccgaacccacggttaacctaccggaccttacggtacccaacggtaccgtaacggttccggtaacccggggg

SEQ ID NO: 144069 - DNA, 775 bp, Homo sapiens
  misc_feature: GYAE6OF02IFSIF.35.87.H10.1.454.CMB.1.raw
  modified_base (458)..(458): a, c, t, g, unknown or other
  misc_feature (458)..(458): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccagtggagtttggctgagcgtgtacttttccgtggtgtcttaattttaaaagttgtcctagtggtgaggtgacaccgtggtggacggtcggggcggtaggtcgttacggttaacgccggtaagggacggttacctaaaggacctcctaccgtgtgcctaggtttctcggtactttcccctttacgaagttcgtaccgtccgttggtaacgtcggtaaacggttcgggtaccccgacccgtacgggtccgtacccggaagggggaacgggtaccgtagggacggttcgggttaccgcccggtaacgtaaagtttaaaaagggngtaaaggttgaggtacggacggtaacaacggagtacgtacgtcctaccgtaccgtacgacggcagtctccgacctcgtcgagagtacgtacgtacttccgaagttagtacgttacgttaccgttcgttacctaacgtaataaacgtaacgaccgtaacgaccgttaccgaacgtaaaccggaccgtaaccgaacgtaccgaccgttactaacgtttaccgaccgtttacccgacgtttaaccaccgaacctaaccgtaacgtcgtaccctaacggttaccccgaacggtaacggttaccggttacgggtaccggggg

SEQ ID NO: 144070 - DNA, 663 bp, Homo sapiens
  misc_feature: GYAE6OF02HHMQP.35.87.H10.1.454.CMB.1.raw
  modified_base (318)..(318): a, c, t, g, unknown or other
  misc_feature (318)..(318): n is a, c, g, or t
  modified_base (336)..(336): a, c, t, g, unknown or other
  misc_feature (336)..(336): n is a, c, g, or t
tcagtacagatcgtcacgaccggtgctcgatttagcagtactgcgttgggtttggggagctctgggagaggagccccagccttgggattcccaagtgttttcattcagtgatctggactgaactacagaggactcaccatggagtttgggctgagctggtattttccttggtgcttattttaaaagttgtccagtgtgaggtgcaccgtggtggagtcggggcggaggtcttgttaagccgaggacgggtccctaagacctctcctgtgctagttctggtacttccctttcaatcgtcgcctggatgaactgggtccncgacgctcgaggagggcnggtagtgggttcgcccgagtaagttaaacggagtaacgtgacgtaggacgggaacaacagacgttacgcttccgacgttacacgggcagtactccgacgtctacgaggtactacgtgtacttacgacgttagacggtactcgtcgttaccttactaaccgtaaagcgtaaacgcgacccttagaacccgtaacggaacgaacctaccgaacggtcccgttattaacgttaccgacgtttaacccaacgttcccgtaaccgacccttaaacgccgtcccggacttacccgtacgaaccccggtactaaccggtgggtaacccgggggg

SEQ ID NO: 144071 - DNA, 602 bp, Homo sapiens
  misc_feature: GYAE6OF02GFOU8.35.87.H10.1.454.CMB.1.raw
  modified_base (295)..(295): a, c, t, g, unknown or other
  misc_feature (295)..(295): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (442)..(442): a, c, t, g, unknown or other
  misc_feature (442)..(442): n is a, c, g, or t
  modified_base (470)..(470): a, c, t, g, unknown or other
  misc_feature (470)..(470): n is a, c, g, or t
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggattttccttggtgcttattttaaaagttgtccagtgtgaggtgcaccgtggtggagtcggggcggaggtcttcggttaagccgagggtacgggtccctaaagactctcctgtgctagtttctggtacttccctttnaatgtcgctggatgaactcgggtccncgaggcncgagggaggactggaggtggtcgccgacaagttaaaaggagtaagtgagtggacggacaacgagactacgccgttaccacccgttcgagggcagtacttccaccgtctacaganatgattccatgatctcctgtctactaanaatacgacacgctagaaccaaccgagaacacgaacgccgttactacttactcgtaacctacgttccagacccaacgtaccgtacgtaccctacttaccgaaccggtaacgttacgttcgggtacccgggggg

SEQ ID NO: 144072 - DNA, 668 bp, Homo sapiens
  misc_feature: GYAE6OF02HK4IX.35.87.H10.1.454.CMB.1.raw
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (451)..(451): a, c, t, g, unknown or other
  misc_feature (451)..(451): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttaattttaaaagttgtccagtgtgaggtgccacctggtggagtcgggcggaggcttcgtaagccaggaggtccctaagactctcctgtgctagtttctggctttcccttcaatgtcgcctaggatgaacgtgggcccncaggctccggagggaggacgtggaggtgggttcncccggtnaagttaaagggagtaacttgagtaggacgggaacaacgacgaactacgcttaccgacccgttgaacggcagtacttcaccggtcctaccaggtaacgntacggtacttccgaagttacggacgttacttacccgttgtaccttacttaaacgaaattcgaaacgtacgtacccgtagaaccgaaccgaacgggtaacccaggtaaaccgtccgtaaccttaacgttaccgttaccgaacccttacctccgtacctacaacccgtcgtacgtacccacgttacccaggttaaccccgttagttacgggtaccgggg

SEQ ID NO: 144073 - DNA, 749 bp, Homo sapiens
  misc_feature: GYAE6OF02FU112.35.87.H10.1.454.CMB.1.raw
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagttgggctgagctggatttcctggtgctatttaaaagtgtccagtgtgaggtgcacctggtggagtcggggcggaggcttcggttaacgcctagggaggggtccctaaggactctcctgtgctagtttctggtacttccctttnaacttggtccgccgtggactgtaacgttcggggtcccncgacggctccgagggtaacgggctgggaggtgggttcgaccgacgtaagtaaacggagaattggagtgggacggtaacaaacgacggaccgtacgtcttaccgacccgttgacgggtcacgtacgttcccgaccgttactaccgaagtacgtaactcgttaacttaccgaagttgtaacgttaacttccgttacggttaccgtttaaaccgtattaaaacccgttacggtaaaccgtccggtacccgtttaacggaaaaccggaaccgggtaaacggttaacccgaaccgttaccggacccgggttaacctttaacgtttaccggtaccgttaaccccagttaccccgtaagttaaccccaaccgtaacgtccggtacctacccgttaccgtaacccggtaattaacggttcccggtaccggggg

SEQ ID NO: 144074 - DNA, 675 bp, Homo sapiens
  misc_feature: GYAE6OF02IFW5Q.35.87.H10.1.454.CMB.1.raw
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (431)..(431): a, c, t, g, unknown or other
  misc_feature (431)..(431): n is a, c, g, or t
  modified_base (524)..(524): a, c, t, g, unknown or other
  misc_feature (524)..(524): n is a, c, g, or t
tcagtacagatcgtcacgaccggtgctcgatttagcagtactgcgtttgggtttggggagctctgggagaggagccccagccttgggattcccaagtgttttcattcagtgatctggactgaacacagaggactcaccatggagtttgggctgagctggattttccttggtgcttattttaaaagttgtccagtgtgaggtgcacctggtggagtcgggcggaggtcttcggttaagccgagggacgggtccctaaagacctcctcctgtgcctagttctggtacttccctttanatcgtccncctggactgacgtcggccgcacggctccggaggggaacggacgtgggaggtgggttcgcccgtacaagttaaaaggagtaattgaacgtggacggacaacgacggtactacgtcgtacctacccggtnacgggtcagtacgtttccgaccgttcctaccgaaggtacgaacgtgtacttcagtcgagttactccgttagtcctaactaataactagaaccngtaccctagaccaacgggaacgaccgaccgacgtcccgtattaaccttacgtaccgttaacccacgttaccgacccgaaccgaacccgtacctacggaccctttaaccgttaccgaaccgttacgtaaccggttccgggtaacccgggggg

SEQ ID NO: 144075 - DNA, 741 bp, Homo sapiens
  misc_feature: GYAE6OF02GJ3V9.35.87.H10.1.454.CMB.1.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
tcagtacagatcgtcacgaccggtgctcgatttagcagtactgcgttgggtttgggggagctctgggagaggagccccagccttgggattcccaagtgtttcattcagtgatctggactgaacacagaggactcgaccatggagtttgggctgagctggtattttcctggtgcttattttaaaagttgtcagtgngaggtgcacctgggtggagtcggggcggaggtcttacgttaagccagggagggtcccaagactctcctgtgctagttctggacttcccttnaagtgtcgtcctggatgacgtcgggtccgccagggcctaccgagggaacgggacgtgggaggtgggtcgcccggtactaaggtaaaacggtaggaatttggaggtggacgggaacacgagacctacgcttaccgaccgttcgaggcaagtactttccaccgtctacccgagtacgacgtacgtactccaagtcgtaacggtacttccggttactccttacctaaacgtaaacttaaggaacctacggtacccgtaacgaaccctaaaccgggaacggaacctacgaacccggtccgttaaaccgttaacccgtttacgttaccgttaaccccgtacccgtttaccgtaaaccggtaaccccgtaaaccgttacccggtaacgggtccccttaaccgtttaccccggaaaacggttacccggtttaaacggtaccccgggggtttaaccggggggg

SEQ ID NO: 144076 - DNA, 790 bp, Homo sapiens
  misc_feature: GYAE6OF02I0LFA.35.87.H10.1.454.CMB.1.raw
tcagtacagatcgtcacgaccggtgctcgatttagcagtactgcgttgggtttggggagctctgggagaggagccccagccttgggattcccaagtgtttcattcagtgatctggactgaacacagaggactcaccatggagtttgggctgagctggattttccgtggtgctaatttaaagtgtaccagtgtgaggtgcacgtggtggagtcgggcggaggcttcggttaagccgaggtacgggtccctaagacctcgtaccgtgtagtcgtagtttcgtgggtactttaccccgtttcgtaaagttcgttccgtaccccgttgggtaaacttcggtaaaccggtttcggggtccccgtaacccgtacggggtcccgttaccggaacgggggtaaacggggtaccgtaggggtaacgggtttgggggtttacccgccccgggtactaaacggttaaaaacgggtaacggtaaagtttacggaagtaccgggtacggggaaacctaaacggacggtaaacgtacgtacccggttactaaccccgggttacgaggggcctaaggtacgtacccgtaccgtacgttaccgagacgtagtgtactcgtacgtcggaacttacgtcttcgttacctacgtacaaactacggtaacacgtacgtacgaacccgtaaacggacgaaccacgtaacggccttaagtaccttacgacgtacctacgtccgttaaccgactaaccgtacgtaccggtacctaccgtaccgtactaacggtaccgtttgggaaccccgggg

SEQ ID NO: 144077 - DNA, 588 bp, Homo sapiens
  misc_feature: GYAE6OF02FKW3I.35.87.H10.1.454.CMB.1.raw
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcggggcggaggcttcggttaagccagggagggtccctaaggactctcctgtgctagtttctggatttccctttcaattgtcgcctggatacgaactgggtccnccaggcctccgagggaaggctggaggtgggttcgccgnaagttaaaaggagtaagttgagtggacgggaacaacagactacgcttacgacccgttgacgggtcagtattcagtcgtctcagagtatgatcatgattctactgttctactanaatnaanacgtctagaacaacgacggaccacgacgtccgtactattacgcgttacccgacttccgacgtacccaacgttaccgtgtaccctaccgttacgaaccgtacgtatttacccgggg

SEQ ID NO: 144078 - DNA, 742 bp, Homo sapiens
  misc_feature: GYAE6OF02JN4SP.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccgtggtgctattttaaagttgtccagtgtgaggtgcacctggtggagtcgggcggaggcttcgtaagccgagggacggtccctaaggtacctcgtccgtgtgctagtttctggtacttccctttacgaagtcgtccgtccgtaggtactcggtaacgttcgggtcccgaccgagggtcctaccgaggggaacggccgttaggggtagtcggggtcgacccggctaaaggttaaacggaggtaacttagggacgtacgggtacgggaacctaaggacggtactaccggacttccgtaacccgttcggacgggtacgacgtagttacccgaccggttctaccgtaacgaaggtactacggtacgtttaccaagttacggtaacgttacttacccgttggttaacccttacgtaaacctaaacgtacggaaccgtaccgtacctacggtaacccaaccgggtaggaaccctgaaccgtccgttactaacgttaccgtacgtaacctccgtaaccgtcgaaacccgtcctacgtacggaccctcgtaaccctaacggtacgtaccgttcggtacccgggggg

SEQ ID NO: 144079 - DNA, 666 bp, Homo sapiens
  misc_feature: GYAE6OF02FMG74.35.87.H10.1.454.CMB.1.raw
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (422)..(422): a, c, t, g, unknown or other
  misc_feature (422)..(422): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagtgtccagtgtgaggtgcactggtggagtcgggcggaggcttcgttaagccgagggacgggtccctaagactctccgtgtgctagtttcnggtacttcccctttnaattgtcgcctggactgaactcgggtccgcaggcctccgaggggaacggctgggacggtgggtcgcccggntaaagttaaaagggngtaattggacgttgggacggaacaacgagactacgcttacgacccgttnacggggcagactttccacggtacctccaggacgtacttgacttccattgaacgttactccgtgttacctactaaactaaacgtgaaacctagccctagaaccgaacccggaaggtaaccaaccgagtacccgttataaccgtttacgaccgtacccgtattcccgtacgtaaccccacgtacccgttggacccttaaccgttcccgaacggtaacccggtaacgtttcccggggtaaccggggg

SEQ ID NO: 144080 - DNA, 763 bp, Homo sapiens
  misc_feature: GYAE6OF02JD66R.35.87.H10.1.454.CMB.1.raw
  modified_base (222)..(222): a, c, t, g, unknown or other
  misc_feature (222)..(222): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgtcttaattttaaagttgtcctagtgtgaggtgcacgtggtggagtcgggnggaggcttcgtaagccaggacggtccctaagactctcctgtcgtctagttctggtactttcccttcaattcgtccgacctggactcgtaacgttcgggtccctccgacgggtcctaccggagggggtaaacggtccgtagggtaggtcgggttccgacccgtacgtaaagttaaaacgggagtaagttcggaacgtcggaccggggaactaaaccggaaggtaccgtacggtccttaccgaaccccggtttcgaacggggtactaacgtcgttaccgacccgttaccaccgtacggtaaaacgtcgtacgtaccttacgaagttacgtaaccgtaacttaccgttacgttaccttaaccgtaaactaaacgttacgaaaccgtacgaccgtacgtaaccgtaaaccggaacgaccgtaaaccgaccgtaccgttaacgtaaccgtttagttaccgtaaccgtaccgtaccgtacctaaaccgtccgtaacgtccggtaccacgttacctaaccgtaaccgtacgttaccggtaaccggggg

SEQ ID NO: 144081 - DNA, 608 bp, Homo sapiens
  misc_feature: GYAE6OF02F02EC.35.87.H10.1.454.CMB.1.raw
  modified_base (287)..(287): a, c, t, g, unknown or other
  misc_feature (287)..(287): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaagttgtccagtgtgaggtgcacctggtggagtcgggcggaggcttcgttaagccagggacggtccctaaggacctctccgtgtgctagtttctggtattcccctttnaatgtcgtcctggactgacgtgggtccgccaggcctccgagggaacgggacgtgggagtgggtcgcccgctaagttaaaggagtaagttgagtggacggacaacgagactacgcttacaccgtcgacggcagactacgaccgtctaccagagactgtattcatgtactatccttctctctaacaatcgaacacgactacgaccgaaccgagaaccacgaccgtaccgtacttacgttacctagtaccctacgtaccgtccgaacccacctaccgtgtacctaccttacgacccggtaacgtacggttaccggtaccggggg

SEQ ID NO: 144082 - DNA, 603 bp, Homo sapiens
  misc_feature: GYAE6OF02JZVQ3.35.87.H10.1.454.CMB.1.raw
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (470)..(470): a, c, t, g, unknown or other
  misc_feature (470)..(470): n is a, c, g, or t
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggatttcctggtgctatttaaagttgtcagtgtgaggtgcacctggtggagtcgggcggaggcttcgttaagccagggaggtccctaaggactcgtcctagtcgctagttctggacttccgttcaatgtcgcctggatgaactgggtccnctacggctcgagggacggctggagttggtgcccgnacttaaagggctaagtcgagtcggacggacaacagactagcttacaccgttcgaggacagtactcgaccgtctacgagagtatgtactcagtacgagtactccgtgtactactaacaaatcaaacgtntacccgtaagaaccgtaaaccggaccgtaacaacgaacgtcctaacttactaccgtcgtaaccaccgttcaacgtaacccacgtacgtacgccctaacgttcccgaagtaacgtacgttacggtaacccgggg

SEQ ID NO: 144083 - DNA, 657 bp, Homo sapiens
  misc_feature: GYAE6OF02F10AG.35.87.H10.1.454.CMB.1.raw
  modified_base (297)..(297): a, c, t, g, unknown or other
  misc_feature (297)..(297): n is a, c, g, or t
  modified_base (364)..(364): a, c, t, g, unknown or other
  misc_feature (364)..(364): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
tcagtacagatcgtcacgaccggtgctcgatttagcagtactgcgttgggtttggggagctctgggagaggagcccccagccttgggattcccaagtgttttcattcagtgatctggactgaacacagaggactcaccatggagtttgggctgagctggtattttccttggtgcttaattttaaaagttgtcagtgtgaggtgcacctggtggagtcgggcggaggcttcggttaagccgagggacgggtcccctaagactccgtcctgtcgctagtttctggtacttcccctttanaattgtccgcctggatgaacgtgggtcccgccaggcctaccgaggggaacggactgggagtgggtcncccgataagtaaaggagaagttgagtggacggacaagacgacgtacgtcttaccgacccgttagacggggacagtaccttaccgtaccgtcctaacccgaaggacgtacgtaggtacttccaagttacgacgtaccttcgtcgtaccttactaacaaagtnaaaccngtactacgaaccaaccggtagaccacgacggccttacttaacttaccttacgaacccctacgtctaaccggaaccctactacgtccgactaccttaccgaacggtacttacgtggtaacccggggg

SEQ ID NO: 144084 - DNA, 598 bp, Homo sapiens
  misc_feature: GYAE6OF02HKD2X.35.87.H10.1.454.CMB.1.raw
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
  modified_base (466)..(466): a, c, t, g, unknown or other
  misc_feature (466)..(466): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccgaggagggtccctaaagacctctcctggtcgcagtttcnggtattccctttnaatgtcgcctggatgaactggtcccgcaggctcgagggaaggctggagttggtgcccgnaagttaaaaggngtaattgagtggacggaacaagagactacgcttacacccgtnaggcagtattccaccgtctccagagatgacttccagtgatactccttgtctactaacaaatgaacngacctacggaacaaaccgacggaacacgaacgtcccgtattaacgttacctcgtaaccctacgttccgacgaaccctacgaacgtcggaacctaccgttacaaccggtaacgtaagttccgtaaccgggggg

SEQ ID NO: 144085 - DNA, 672 bp, Homo sapiens
  misc_feature: GYAE6OF02IH377.35.87.H10.1.454.CMB.1.raw
  modified_base (244)..(244): a, c, t, g, unknown or other
  misc_feature (244)..(244): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
tcagtacagatcgtcacgaccggtgctcgatttagcagtactgcgttggggtttgggggagctctgggagaggagccccagccttgggattcccaagtgttttcattcagtgatctggactgaacacagaggactcaccatggagtttgggctgagctggattttcctggtgcttattttaaaagttgtcctagtgtgaggtgcaccgtggtggaggtcgggcggaggcttcgttaagccaggnggtaccctaagacctctctgtgctagttctggtactttcctttcaattcgtcncctggatgaactgggtcccncctacggctccgagggaacggcgtgggacggtgggtcnccgactaagtaaaaggagtaattggagtggacgggactaaacgagtaactacgtactccgtacccgttcacggggtcagtacttaccgaaccgtcctaccgaagtacggaatagtacttaccaagtcgtaagttactccttacgtcttaacctaataaactacgaaactggtccctaacgaccgaaacgggacgaaccaccgacgtacccgtactacgttactaccggtacctaccgttcgtacaacccgtacttacccgtggtacccttaccgttaccgaaacccggacgtttacccggttcggtaacccgggggg

SEQ ID NO: 144086 - DNA, 816 bp, Homo sapiens
  misc_feature: GYAE6OF02JJRFD.35.87.H10.1.454.CMB.1.raw
  modified_base (102)..(102): a, c, t, g, unknown or other
  misc_feature (102)..(102): n is a, c, g, or t
  modified_base (667)..(667): a, c, t, g, unknown or other
  misc_feature (667)..(667): n is a, c, g, or t
  modified_base (675)..(675): a, c, t, g, unknown or other
  misc_feature (675)..(675): n is a, c, g, or t
tcagtacagatcgtcacgaccggtgctcgatttagcagtactgcgttgggtttggggagctctgggagaggagccccagccttgggattcccaagtgtcttntattcgagtgatcgtaggtactacgaacacgaaggacggtacctaccactagtgggttaggtttgggctaggacgtcgttaggtttacgttttttccgttggtcgttaacttttaaagtttttaaacgttccgtaccgtaggttggtaggtaggtcgaccgtacggttgggtggtacgggtcgggtacggtacggttcttacggtaacgccgaagggtaccggtaccgtaagcttccgtcgtgtcgacgtttagtttcgcggttacctttccgttacgtaagttcggttccgaccgtggtacgtacggtaaccggttcgggtacccgacggtaccggtcccgtaacggtaacgggggtaaacggtcggtagggtacgggttcggggtacccgaccggtaacgttaaaacggtaaaggggtaataacggttaggtacggtacggggaaccggtaaacaacggtaacgtacggttaccgtaccttcccggtaacgtcggaacgcgtaacgtctaccgtacctcgtaccgagagtacgtagtactacgtgtacgtagtacgttcgttntaccgtanaatagacacgtcgacctacggaaccgacggacacgtaccgtacgtaacttcgttaacttaccgtacgaccctaccgtacgtaccggaacctaacgtccgtaccggcttaacccgacgtaaccggttactaccgggttcggg

SEQ ID NO: 144087 - DNA, 725 bp, Homo sapiens
  misc_feature: GYAE6OF02G0HDF.35.87.H10.1.454.CMB.1.raw
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatgggagtttgggctgagctggtattttccttggtgcttattttaaaagttgtccagtgtgaggtgcacctggtggagtcgggcggaggcttcggttaagccgagggacgggtccctaaggactcctcctggtgctagtttcnggtactttccctttacatcggttcnccgtggatagaacgtgggtacccgcgaggcctaccgaggggaacgggcgtgggaaggtcggggttcgacccggtagaaagttaaaagggacgtaaagttggagttagggacggggtaacaaacgacggaaccgtaaccgtccttaccgaccccgttacgacgggctaaggtacttacccgtaccggtaccttaacccgagaagtactcggtaactttcccgaagtggtaaccgttaaccgttccttacgtaccttactaaaccgtaaaagttaccggaaactccggtacccgtagaaacccgtaaacccggaggtaaccaccgaacgtccgtacttaacgtcctacgttaaccgccttaacgtaccaccgtacctcgtacggtccacgttaccgacgtaacgtacgttcggtaccggggg

SEQ ID NO: 144088 - DNA, 811 bp, Homo sapiens
  misc_feature: GYAE6OF02HBMG6.35.87.H10.1.454.CMB.1.raw
  modified_base (639)..(639): a, c, t, g, unknown or other
  misc_feature (639)..(639): n is a, c, g, or t
tcagtacagatcgtcacgaccggtgctcgatttagcagtactgcgttgggtttggggagctctgggagaggagccccagcccttgggattcccaagtgttttcattcagtgatctggactgaacacagaggactcaccatggagttgggctgagctggattttccttggtgctatttaaagttgtccagtgtgaggtgcacctggtggagtcgggcggagggcttcgttaagccgagggtacgggtaccctaagtacctctcctgtgctagttctggtactttccttacgatcgtacgccgtaggtatggaacgttcgggtcccgaccgacggtccgtcccggaagggggtaacgggaccggttgggaagggttcggggttaccgaccccgggtagtaaaggtttaaaaacgggtacgtaaagtttcgggaggttacggggacggggtaaccaaacggtacggaaacccgtttacggtacccttacccggtaaccccgttcggaacggggtaccgtaacggtactttccccgaaccgtttcccgtaaccctaagggaaccgtgttacgtaccgttaccaaggttcgtaaccggttatcccgtttcgtaaacgttctaaacgtaaactacggtaaaaccncggttacccaggaaaccccggtaaccggtaaggacccctaagtaacggcccgttaaactacccgttaaccgttacgttaaccctaccgtgtaaccccgtaacccgtatacccgtacggtacccacccgtttaccggaacggtaaccgttacgggtcccggtaacccgggggg

SEQ ID NO: 144089 - DNA, 867 bp, Homo sapiens
  misc_feature: GYAE6OF02ICFCK.35.87.H10.1.454.CMB.1.raw
  modified_base (304)..(304): a, c, t, g, unknown or other
  misc_feature (304)..(304): n is a, c, g, or t
tcagtacagatcgtcacgaccggtgctcgatttagcagtactgcgttggggtttggggagctctgggagaggagccccagccttgggattcccaagtgttttcattcagtgatctggactgaacacagaggactcaccatggagtttgggctgagctggattttccttggtgtcttattttaaagttgtaccagtgtgaggtgctaccgtggtggaggtcggggcggaggtcttcggttaacgccgagggacgggtccctaaaggacctcctccgtgtcgctagtttctggtactttccctttnaattcgtcgccgttaggacttacggaaccgttcgggtcccgaccgacgggtccgtaccggaaggggaagggtacggtagggtagggtcggggttaccgcccggtactaaaggttaaaagggacgtaagttcggagttcgggacgggaacaacgacgtaacctacgtcttaccgtacccggttacgacgggacgtacgtactttaccgacccgtttacgacccgtaggtaacgtacgtacgttaaaccgtttccgaagttacggaacggttttaaccgttccttaccggtttacccttaaaccgtttaaaacctaaaacggttacgtaaaacccggttacggtaaccccgttaacggaaaacccgtaaacccggggaaacggtaaccccgtaaccgtaaaccgggttacccgttaaccgtttaacgtttaacccgtaccggtttaaccccctaaccggtttaaccgttacccgaaaccccttaccgtaaccggttaacccggttaccttaacccgttaccgaacccggtaaaccggtttaccgttcccgggggtaaccgggggg

SEQ ID NO: 144090 - DNA, 671 bp, Homo sapiens
  misc_feature: GYAE6OF02HI26R.35.87.H10.1.454.CMB.1.raw
  modified_base (217)..(217): a, c, t, g, unknown or other
  misc_feature (217)..(217): n is a, c, g, or t
  modified_base (285)..(285): a, c, t, g, unknown or other
  misc_feature (285)..(285): n is a, c, g, or t
  modified_base (424)..(424): a, c, t, g, unknown or other
  misc_feature (424)..(424): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggatttcctggtgctattttaaagttgtaccagtgtgaggtgcaccgtggtggagtcgggnggaggcttacgttaagccaggacggtcctaagactctacctgtgctagtttctggtactttccctttnaattgtcgtccgtaggtacttagaaccgttcggggtacccgccgtacgggcctccggaaggggaacgggaccgttgggaggttcggggttcgccccgataaggttaaaaggacgtaagttggaggttcggacgggtaanaacgacgaccgtacgtcttaccgacccgttacgacgggtacacgtacttaccgtacccgtacctaccgacggaagtacgtagtacttacagtggaacttcgtctcgtccttactaaactaatacggaacacgtacctagaaccgtaaccgacgaccacgaacgtcgtacttacttactacgtactaccttctacacctaaccacgtcgaccgtactacgaccgtacgtacgttcccgggtaacgggg

SEQ ID NO: 144091 - DNA, 592 bp, Homo sapiens
  misc_feature: GYAE6OF02F3KJN.35.87.H10.1.454.CMB.1.raw
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcggttaagccagggacgggtccctaagactctcctgtcgctagtttctggattccctttnaacttgtcgcctggatgaacgtgggtccnccaggctccgagggaggactggagtgggttcgcccgnaagttaaaggngtaattgagtggacggacaacgagactacgctagacccgttgagggcagactcaccgtctacgagagatgatccatgatatctgtactactaacaatcgaacacgacctagaaccaaccgtagaccacgacgtcccgtatacttaccgtactaaccgtacctctacgtacccaacgtaccgtcggacctaccgttaccgaaccggacgtaacgttccggtaaccggggg

SEQ ID NO: 144092 - DNA, 915 bp, Homo sapiens
  misc_feature: GYAE6OF02ILI9Q.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctgactgaacacagaggactcaccatggagtttgggctgagctggatttttccgttggtgtcttaagtttttaaaagttgtccagtgtgacggtgctacgtggtggaggtcgggcggaggtcgttacgttaagccgagggacggttaccctaaagacctccttcctaggtcgctagtttcgtggttactttccctttcgaattcgtaccgccgttgagttcgaaccgttgggacccgtccaggccgtacccggaaggggagggaccgttgggaggttcggggtcgacccggtacctaaaggtttaaaacgggaagtaagtttcggaggttagggacggaaccggtaaacgaacggtaacgtaacccggtactttaacccgtaaccccgttcggaacgggtccgaggttaaccttacccgtaaccggttaccctaccggtaaacgtaacggtaacgtacggttaactttacccgtaagttccggtaaacgtttaactttccggtttaacgtttacccgttaaccggttaaaccttaaaaggtttaaccgaaaccgtaaccgtaacccgttaacggaaacccccggttaaacccggggaacgggttaacccaaccccggttaaacggtacccccgttttaaaccgttaaccgtttttaaccccggttacccgttaaccccgttacccggttaaccccttaaccgggaaacccttaaccccggttaaccccggtaggttaccccctaccgtttacccggtaaacccggtaaacggttaccccggtttacggggtaaccccgggggg

SEQ ID NO: 144093 - DNA, 828 bp, Homo sapiens
  misc_feature: GYAE6OF02H1RBW.35.87.H10.1.454.CMB.1.raw
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (407)..(407): a, c, t, g, unknown or other
  misc_feature (407)..(407): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttattttaaaagttgtccagtgtgaggtgcaccgtggtgggagtcgggcggaggcttcgttaagccgagggacggtccctaaagcctctcctgtgctagttctggacttcccttnaatcgtcnctggatgaacgtgggtcccncgaggctacggaggggaaggacgtgggaggtgggttcgcccgtagaaagttaaaagggactaaagttggaagtcgggacgggactaaacgngtaaccgtacgtccgttacgaccccgtttacgaaggggtcctaagtacctttaccgacccgtttacgtacccgtaagacggtatacggtaccgttaccgaattacgggtaaacggttaaccgttcccttaacgggttttaccctaaacttaaaccgttaaaacgtaacggtaaacctaaccgggtacccgtaaacggaaaacccgtaaacccggggaaccggtaaaccccgaaaccgttccgggaaacccgttttaaccgttaaccgtttaacccggtacccggtttaaaccccgtaacccgttaccctaaccgggtaaaacccccgtaacttaacccggttacccgggtaccctttaaacccttacccggaaaccccgggttaaagttaaccccggtttaccggggaacccggggggggg

SEQ ID NO: 144094 - DNA, 836 bp, Homo sapiens
  misc_feature: GYAE6OF02GXML1.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagcgtggattttccttggtgcttattttaaagttgtccagtgtgaggtgcaccgtggtggagtcgggcggaggtcttcggttaagccgagggacgggtaccctaaagaccgtctccgttggtgtcctagtttctagggtactttcccgtttacaatcggttccgccgttagggacttacggaaccgttcggggttacccgacccggtaacggcccgttacccggaagggggtaacggggtaccgttaggggtacgggtttcggggttccggaccccggtaacgtaaagggtttaaaaaacggggtaggttaaaagttttacgggaaggtttacggggaacccggggtaaacgtaaaacccggaacggtaaacccgtttaaccggtaccgttttaacccgtaacccccgggtttacggaaccggggtaccgtaaacggtaccgttttaaccgtacccggttcctaacccggaagtaacgggtaactcggttaaaccttaccgtaaggttaccgtaacggttaacttccgttcgtaaccttactaaaacgtaactacggaacacgtaccgtaacgaccgtaacgaggtaaccacgtacgtccgttatacgtctacgtacctacgtcgtaccaacgtacacggtacacccgtaacgtccaacggtacgttacgtaccggtacggggg

SEQ ID NO: 144095 - DNA, 819 bp, Homo sapiens
  misc_feature: GYAE6OF02INLYO.35.87.H10.1.454.CMB.1.raw
tcagtacagatcgtcacgaccggtgctcgatttagcagtactgcgttgggtttgggggagctctgggagaggagccccagccttgggattcccaagtgttttcattcagtgatctggactgaacacagaggactcaccatggagtttgggctgagctggtattttccgtggtgcttaattttaaagttgtccagtgtgaggtgcaccgtggtggaggtcgggcggaggtcttacgtaagccagggtacggtcctaagactctccgtgtgctagtttcgtggtactttccctttcaattcgtccgtcctggtacgtgaacgttcgggtacccgccgaggtcctacccggaagggggtaacgggacgtgggtaggttcggggtttccggaccccggtagtaaacggtttaaaaaacgggcgtaaaagtttaggtaaggttcggggaaccgggtaaacaacggaacgtaaccggtaacgtccgttacccgtaacccgggtttcaacggggccgtaacggtactttcccgaaccggttcctaccgtaaggacgtatacggtaacttcctaagttgtaacgttaacgtcccgtttaggttaccccttactaaacgtaagtacggaaaccttcggtaaccctagaaaccccgtaacggaacggtaaccaacgaccgggttaccctacgttaaaccgtttaccgtaccggttaacctaccccgtttaacgtaacccgtaaccccgtaaccgttaaccggtacggtaccccttaacgttacccgaaacccggtacgttaaccggtttaccgggtaacccgggggggg

SEQ ID NO: 144096 - DNA, 1051 bp, Homo sapiens
  misc_feature: GYAE6OF02GKXTU.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggtattttccttggtgcttattttaaaagttgtccagtgtgaggtgcacctggtggagtcgggcggaggtccttacggttaacgccgagggtacgggtacccctaaaggaccgttcctccgtggtcgtacgtaggttttaccgtcgggtaacttttcccccgtttactaaacgtttcggttcccgtcccgttaggggtaacttaggtaaacccggttcgggggttaccccggtacccgaacggggtccccgttaccccggaaaggggggtaaaccggggtaccgttaaggggacgggttgggggtttcccggccccggtaacgttaaaaggttaaaaaacggggacgttaaaacggttttggaaacgggttcggggtaacccggggtaaaccgtaaaccggaacggttaaccgttaaacccgggtacgtttaccggggtaacccccgggtttacgaaccgggggtccgtaaacggttaccgttttaaccccggtaacccggtttacccggttacccgtaaacggggtaaacgtaaccggtttacgtaaaccgttttaccccggaaagtttccggtaaaacggttccttttaccccggttacggtttaccctaacgttaaaacccgtaaagttacgaaaacccgtaccggtacccgtaacgggtaaacccgtaaacccggggaacggtaaccccgtaaacgtacccgggtaaaccccgtttacgtttaaaactttaccccggttaacccgtttaaccccgtaaccgtttccccgggtaacccgtaaaccccgtaaaccgttaaccccggtttagggaacccctttaaccccggtttaaccggtaaaacccgggttaacccggtttaacggtttcccggggtaaaccccgggggggg

SEQ ID NO: 144097 - DNA, 733 bp, Homo sapiens
  misc_feature: GYAE6OF02HQF3L.35.87.H10.1.454.CMB.1.raw
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
  modified_base (503)..(503): a, c, t, g, unknown or other
  misc_feature (503)..(503): n is a, c, g, or t
tcagtacagatcgtcacgaccggtgctcgatttagcagtactgcgttgggtttggggagctctgggagaggagcccccagccttgggattcccaagtgttttcattcagtgatctggactgaacacagaggactcaccatggaggtttgggctggagctggtattttccgttggtgctttaattttaaagttgtaccagtgtgnggtgcacgtggtggagtcgggcggagtcttgtaagccgaggacggtacctaagcttcctcctgngtctagtttctggtacctttaccctttataagttcgtcgtccgtggtatacggtaaccggtcgggtcccgaccgacggtccgtaccggaaggggtaacgggtacggtcgggtagggttcggggtcggacccgtaagaaggttaaaaggtagtagttacggaggtcgggacggaacaacgtagaccgtacgtccttcccgtaccgtacggaggcgtagtacttccgtaccgtttcnccgtaagcggtatacgtaactctaaagtcgtaattactccgttattcccttaactaaacgagaacgttaccgaatcccgttaacgaacccgaaacggaccggaactacccgggtctaccgtaaccttttagtacccgtccgttaacccgtactccggtaaccaaccgtccgtacgtcgtacccttaacggtcctaaacccgggtacgtttacccggtggggacccggggg

SEQ ID NO: 144098 - DNA, 846 bp, Homo sapiens
  misc_feature: GYAE6OF02HU5LQ.35.87.H10.1.454.CMB.1.raw
  modified_base (216)..(216): a, c, t, g, unknown or other
  misc_feature (216)..(216): n is a, c, g, or t
tcagtacagatcgtcacgaccggtgctcgatttagcagtactgcgttgggtttggggagctctgggagaggagccccagccttgggattcccaagttgttttcattcagtgatctggactagaacacagaggactcaccatggtggttgggctgagcgtggtattttccgttggtgtacttaatttttaaaaggttcgtcctaggttgtggaggtnccgtaccgttgggtgggtaggtccggggacggaggtctttacggtaacgtccggagggtacgggtaccctaagtaccttcgtccgtgtcgccgtaggttttcgtacggtactttcccgtttacaacgttcggtaccggtccgtagtagtacggtaccggttcgggtacccgccgaacgggtcccgtaccggaacggggaagggtccggtaggtacgggttgggtcccggtaccggtaacgtaaacgggttaaaacgggaaggttaagtacggaacggtacgggtaaccggggaaataaacgacgtaacccggtacgtacccgttcccgtacccgttacggaacggggtactacggtacgtttacccgtacccgtactacccggagtaacggtacgtacgttaactaccgtagtacggtaactttaccgtcctttaaggtccttacctaaagtaaagtaaccaaccgtactaccggtaaccgtaaaccccgaaccgttcgaaccctacgaacccgttcgtaaccctaagtttaccgacctaccgtacttaaccacccgtacctaacggtaacccgcggtaacctaccgggtaccgtaacccgaacggtttacggtacccggtaacgggggg

SEQ ID NO: 144099 - DNA, 776 bp, Homo sapiens
  misc_feature: GYAE6OF02J0DAW.35.87.H10.1.454.CMB.1.raw
tcagtacagatcgtcacgaccggtgctcgatttagcagtactgcgttggggtttgggggagctctgggagaggagccccagccttgggattcccaagtgttttcattcagtgatctggactgaacacagaggacctcaccatggagtttgggctgagcgttcgggttttcctcgttgtcttcgttttaaaggaggtcgtccagtgtcgaggtcgcgtaggcggtgggggacgtcggtaggggggaggtcggtcggtcacggccgtggggtacgtcccgtggaacgtccttccgtcgtggtcgccgaggtccgtgtggtacttccgacccgttgtacggttacgtagtcgggacctagtcgtacgtacggtccgggtccacgaccggtctaccggacggcggaacggggtacgtcgggtaaggtggggtcgacgttaggttagtacggtcggtaactggtacgtagggtaagtacgaaagttaaacgagtacgtacggtacgtaccggtaccgtacggtaagggaccgggtacgttacgtttaaccgaccgttacgtcccggtaacgtaaccggaacgtaaccgttaaaccgttaacccgaaacgtaacccgaacggttacttaacggtcttaaccggttaccgaaacgtaagtaacccgacgtaccgtacgtacggaacgacggtacccgacggtaaccgtacggtcgttaaggttactaacgttacggtaggttaacgaaccgtaaggtaaccggtacggtacgtaggtaaccgg

SEQ ID NO: 144100 - DNA, 763 bp, Homo sapiens
  misc_feature: GYAE6OF02FOVIP.35.87.H10.1.454.CMB.1.raw
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttcctggtgctattttaaaagttgtccagtgtgaggtgcacctggtggagtcgggcggaggcttcgttaagccagggacgggtccctaagactctcctgtgctacgtttcgtggtactttcccctttacaagttgtccgtccgtaggactagtaacctggggtcccgaccctagggcctccgaggggaacggaccgtggggaggttgggttcgcccggtacgtaaaggttaaaaaggacggtaaattggaagtacgggacgggaacaacgagtaacgtaccgcgtttaccgaccccgtttgacggggtaccaaggtactttaccgaccgttctacccgaggtacgaacgttacgacttccgtaattacggtaacgttaacgttccgttaggttaccttacctaaacgtaaacttacggaaacctcgtaaccgttaaacggaccgtaaacccgggagtaacccgaccgtaaacggtcccgttaacgttaactttaccgtaccgttaaccctaccgtaccggtaccaaaccccgtacgtaaccgtaccgaccttaccgttaacccgaaccggtaaccggttacgttaccgggtaacccgggggg

SEQ ID NO: 144101 - DNA, 732 bp, Homo sapiens
  misc_feature: GYAE6OF02GOA5E.35.87.H10.1.454.CMB.1.raw
tcagtacagatcgtcacgaccggtgctcgatttagcagtactgcgttgggtttggggagctctgggagaggagccccagccttgggtattcccaagtgtttcattcagtgatctggactgaacacagaggactcaaccatggagttgggctgagctggtattttccgttggtgtcttaattttaaaagttgtccagtggtgaggtgcgtaccgtggtgggaggtcggggcggtaggcgttacggttaaacgcccgagggtacgggttaccctaagaccttctccgtggtgtcgtagtttcgtggtactttcccttataagtcgtcgtctgagtcgacgtcgggtccgccgaggtccgtaccggaaggggaacgggtacgtgggtaggttcggggttacgaccccgtaaagtaaagttaaaaacgggaaggtaagttagaacggttcgggtaacgggaacaaacgacggtactaaccgtccttaccgacccgttacgagggtaccaagtaccgtttaccgaccgttcctacgagtaacgtactacgtactaccgagtcggtaataccgtcgttcgtaccttaatacaaatacgaaccgtacgtcctacgaaccgtaaaccggaacgactaacggaccacgtactactacgtactaccaacgttacccgtacacccgtactaccgtcgtacctacccgtagtaccgtaaccgttaggttcccgggtaaccgggg

SEQ ID NO: 144102 - DNA, 627 bp, Homo sapiens
  misc_feature: GYAE6OF02GWY0O.35.87.H10.1.454.CMB.1.raw
  modified_base (327)..(327): a, c, t, g, unknown or other
  misc_feature (327)..(327): n is a, c, g, or t
  modified_base (397)..(397): a, c, t, g, unknown or other
  misc_feature (397)..(397): n is a, c, g, or t
  modified_base (581)..(581): a, c, t, g, unknown or other
  misc_feature (581)..(581): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagtttgggctgagctggattttccttggtgtctattttaaaagttgtccagtgtgaggtgcacctgggtggaggtcggggcggaggtcttcggttaaagccagggacgggtccctaagactctccgtgtgctagtttctggtactttcccctttaaattcgtcgccttggatgaacgtcgggtccncgaggctccgaggggaggcgtggagtggtcgccgacaagtaaaggagaattgagtcggacggaacaaagngaactcgcctttaccgacccgttcgaaggctagtaccgttaccgaccgtctaccgagagtactggtaccttccgaagtacgtagtacctcgttactcttactaacgaaatcaaccgtcgacctagaaccaacggtagaaccacgtacgtcccttatactacgtacgtacctagtccacaacccnacgttccgacttacctaccaaggtacgtcggttaccggaccggggg

SEQ ID NO: 144103 - DNA, 742 bp, Homo sapiens
  misc_feature: GYAE6OF02IMW2G.35.87.H10.1.454.CMB.1.raw
  modified_base (696)..(696): a, c, t, g, unknown or other
  misc_feature (696)..(696): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggagttggggctggagtcgtgggtactttttcccgttggtgtacctttaagtttttaaaagttcgtaccagttgtgtaggtgcgtaccgtggtcggaggtcgggcggaggtccgtttacgttaacgccgagggtacggtaccctaagacctctcctgtgtctagttcgtggtacttccttctaacgtggtccgccgtaggtagtacgtaacgtcgggtacccgtccgacggtcccgtaccggaaggggaggaccgtagggtacggttcgggtaccgccccgtaagtaaagttaaaaggagtaagttagaggtcggacgaacaacgagtaccgtacgtccttaccgtacccgtcgacggactacgacgtttccgaccgtcgttaaccgaggtagtacgtacgtacttaccgagttacgaacgttaacttccgtacgttaccacgttaaacgtaaacacgtaacaacgtcctaacgaacccgaacgtacggaacccacgaccgttacctaaccgtttactacgtaccgaaccctacgtcccaacgtaccaagaaccgtntacccgaacttaccgaacgttacggtacggttaccgggtaccgggg

SEQ ID NO: 144104 - DNA, 857 bp, Homo sapiens
  misc_feature: GYAE6OF02JZEI9.35.87.H10.1.454.CMB.1.raw
  modified_base (799)..(799): a, c, t, g, unknown or other
  misc_feature (799)..(799): n is a, c, g, or t
tcagtacagatcgtcacgaccggtgctcgatttagcagtactgcgttgggtttggggagctctgggagaggagccccagccttgggattcccaagtgttttcattcagtgatcgtggactgaacacagaggactcacatggagtttgggctgagctggattttcctggtcgcttaattttaaagtgtcctagtgtagaggtgctaccgtggtggaggtccgggcggtagggtcttacggttaaacggtccgaacggggtacgggttacccgtaaagtaccgtccgttacccgttagttcggtacgtaacggtttttcccgagggttaccttttaccccgtttacaacgttccggtccgtcccgttggtaactgggtaaccgttcggggtaccgtaccgtagggtcccgtaccggtaagggtaacgggtacgttagggacggtttcgggttaccgccccggtaacttaaaaggttaaaacgggagttaaagttcgggtaaggtacgggaccggtaaaccgaaagtacggtaaaccgtccggtcttaacccggtacccggttacgacggggtactacggtactttcgacccgtcgtacccgagtaacgagttacggaacgttccgaacgtggtaacgtacttccgttacgttaacccttaacgtaaacgtaactaccggaactacgttacccgaacgtaacccgaaacgggtaacgaacccgtaaccaacggtacccgttacttaacggtttaacctcgttaaccctacggttaccgtaacctaccccgaacgttaaccgnggttaaccctacggttaacccgtacggtaaacccggttcggttaaaccggtaccgggg

SEQ ID NO: 144105 - DNA, 824 bp, Homo sapiens
  misc_feature: GYAE6OF02GVWP0.35.87.H10.1.454.CMB.1.raw
  modified_base (174)..(174): a, c, t, g, unknown or other
  misc_feature (174)..(174): n is a, c, g, or t
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
tcagtacagatcgtcacgaccggtgctcgatttagcagtactgcgttgggtttggggagctctgggagaggagccccagccttgggattcccaagtgttttcattcagtgatctggactgaacacagaggactcaccatggtagtttgggctgagctggtatttttccttggtntcttaatttttaaaagttcgtacctagtgtgaggtgcacgtggtggaggtcgggcggaggtctttacggttaacgccgaagggacgggtaccctaagaccttcgtccgtagtcgctacgtttctggttacttcccgtttanaagttgtccgtctggatcgacgtcgggtccnccgagctaccggagggaggctgggaggttcggtccgccgctaaagttaaaggagtaattggagttcggacggacaacgaggaacctacgcgtttaccgaccgtacgagggtcagtaccgtacgtccgtcgtaccaggactagtcgtacttcagttagaacgttaccttcgttagtccctaaagttacgaaacgttaacgaaccgtacgtaaccccgttaaggaaccccgtaaaccggtaaacggtaacccgtaaaccgggaacgtttaaacccccgggtttaactttaaccgtttaaacccgtttacccgttaacccccttaaccggttttaaaccccgtcccgggttaaaaccccctttaacccgacccggggtttaaaacccttcccccggttaaaacggttttaacccccgaaaacccggggttttaaacccgtttaacccggggtttacccggggggttaaacccccggggggg

SEQ ID NO: 144106 - DNA, 597 bp, Homo sapiens
  misc_feature: GYAE6OF02FL2C6.35.87.H10.1.454.CMB.1.raw
  modified_base (557)..(557): a, c, t, g, unknown or other
  misc_feature (557)..(557): n is a, c, g, or t
tcagtacagatcgtcacgaccggtgctcgatttagcagtactgcgttgggtttggggagctctggggagaggagccccagccttgggattcccaagtgttttcattcagtgatctggactgaacacagaggactcaccatggagtttgggctgagcgtggattttccttggtgctatttaaaagttgtccagtgtgaggtgcacctggtggagtcgggcggaggcttcgttaagccaggagggtccctaagactctcctgtgcagtttctggtattcccctttcaattgtccgcctggatgaactgggtcccgccgaggcctccgaggggaagggactgggaggttggggttcgccccgcaagttaaaaagggagtaaagtttggaagttcggggacggggaacaaacgaggaacctacgtactttccgaccccgtttagacggggcacggtacttccaccgtctaccgagagagtgattccatgagtactcctgtcctatacaatgaactgacctagaccacgacgacacacgccgtatactactactaccactcncgaaccactacgtgctactccacgacgtattcggacgggg

SEQ ID NO: 144107 - DNA, 684 bp, Homo sapiens
  misc_feature: GYAE6OF02GKJQ5.35.87.H10.1.454.CMB.1.raw
  modified_base (320)..(320): a, c, t, g, unknown or other
  misc_feature (320)..(320): n is a, c, g, or t
  modified_base (436)..(436): a, c, t, g, unknown or other
  misc_feature (436)..(436): n is a, c, g, or t
  modified_base (494)..(494): a, c, t, g, unknown or other
  misc_feature (494)..(494): n is a, c, g, or t
  modified_base (517)..(517): a, c, t, g, unknown or other
  misc_feature (517)..(517): n is a, c, g, or t
tcagtacagatcgtcacgaccggtgctcgatttagcagtactgcgttgggtttggggagctctgggagaggagccccagccttgggattcccaagttgttttcattcagtgatctggactgaacacagagactcaccatggagtttgggctggagcgtggtattttccgttggtgtcttaagtttttaaaagttgtcctagtgtggaggtgcaccgtggtggacggtcgggcggaggtccgttacgttaacgccgagggtacggtaccctaagacctcgtaccgtgtcgtcgttagtttcgtaggtactttcccctttanaattcggtccgccgtggactagtaacgttcggcccgcgacggcctcggaagggacggtcgtgggaggttgggtcgcccgataaacggttaaaggataagttgagtcgggacggaanaacgagaactacggtcttaccgaccgtgaggctagtacgtcaccgtctaccgagactntgtacttcagtggactactcgtntcctagtaaccagtacaactacgacgtacgaaacccacggtaacgacttaccgggaactcccggttaaattaaccgttcccgtaacgttaccctaacgttcgaaacctcccgaaccttcgtaccgatacccgttcgaaaccggtacgtaccgttaggggtcccgggg

SEQ ID NO: 144108 - DNA, 497 bp, Homo sapiens
  misc_feature: GYAE6OF01DTF17.42.81.H04.1.454.CMB.1.raw
  modified_base (187)..(187): a, c, t, g, unknown or other
  misc_feature (187)..(187): n is a, c, g, or t
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaanagccaccctctcctgcagggccagtcagggtgttgacagcaactacttagcctggtaccagcagaaacctggccaggctcccaggctcctcatctatgctgcatccaccagggccactgacatcccagacaggttcattggcgctgggtctgggacagacttcactctcaccatcgagacactggagcctgatgattttgcagtgtatcactgtcagcagtatgctaattcacctctaactttcggcggagggaccaaggtggacatacaaacgactagtggntgcaccatctgtcttnactctccgtcc

SEQ ID NO: 144109 - DNA, 508 bp, Homo sapiens
  misc_feature: GYAE6OF01D2ZS5.42.81.H04.1.454.CMB.1.raw
  modified_base (187)..(187): a, c, t, g, unknown or other
  misc_feature (187)..(187): n is a, c, g, or t
  modified_base (378)..(378): a, c, t, g, unknown or other
  misc_feature (378)..(378): n is a, c, g, or t
  modified_base (496)..(496): a, c, t, g, unknown or other
  misc_feature (496)..(496): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaanagccacctctcctgcagggccagtcagggtgttgacagcaactacttagcctggtaccagcagaaacctggccaggctccaggctcctcatctatgctgcatccacaggccactgacatcccagacaggttcagttcggcgtcgtgggtctgggacagtacttcactctacaccatcgagacacgtggacnctgatgtatttgcgtagtgtatcactgtcagctagtatcgcttaattcacttactacgttacggcggaggacctaggagacatacgaacgaacgtgtcgatgcactatctcgtacttnacttctccgtac

SEQ ID NO: 144110 - DNA, 498 bp, Homo sapiens
  misc_feature: GYAE6OF01C1DPB.42.81.H04.1.454.CMB.1.raw
  modified_base (187)..(187): a, c, t, g, unknown or other
  misc_feature (187)..(187): n is a, c, g, or t
  modified_base (374)..(374): a, c, t, g, unknown or other
  misc_feature (374)..(374): n is a, c, g, or t
  modified_base (469)..(469): a, c, t, g, unknown or other
  misc_feature (469)..(469): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaanagccaccctctcctgcagggccagtcagggtgttgacagcaactacttagcctggtaccagcagaaacctggccaggctcccaggctcctcatctatgctgcatccaccagggccactgacatcccagacaggttcattggcgctgggtctgggacagacttcactctcaccatcgagacactggancctgactgatttgcagtgtatcactgtcagcagtatgctaattcacctctactttcggcggtaggactaaggtgacgatacaaacgactggtcgntgcaccatctcgtcttcactcttcccgcc

SEQ ID NO: 144111 - DNA, 564 bp, Homo sapiens
  misc_feature: GYAE6OF01D69S9.42.81.H04.1.454.CMB.1.raw
  modified_base (187)..(187): a, c, t, g, unknown or other
  misc_feature (187)..(187): n is a, c, g, or t
  modified_base (218)..(218): a, c, t, g, unknown or other
  misc_feature (218)..(218): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaangccaccctctcctgcagggccagtcagggtnttgacagcaactacttagcctggtaccagcaagaaacctggccaggcctcccaggcctcctcatctatgctgacactccgacnggccatgacnctacccagacctaggttcagttggcgtcgtgggtctgggacagacttcactctacaccngtacgagacatggactcctgattgtatttgctagtgtatctactgtcagtcagtctgtactactctaccttacttaaccgttcgggacgggtacggaaccgtagggacgtacgataaccgaaacgtaacgtcggtcggcttcgacctaccgtaagttccgttacgttacccttactacttcccgtcccctaccg

SEQ ID NO: 144112 - DNA, 551 bp, Homo sapiens
  misc_feature: GYAE6OF01ALQ9J.42.81.H04.1.454.CMB.1.raw
  modified_base (187)..(187): a, c, t, g, unknown or other
  misc_feature (187)..(187): n is a, c, g, or t
  modified_base (379)..(379): a, c, t, g, unknown or other
  misc_feature (379)..(379): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaanagccaccctctcctgcagggccagtcagggtgttgacagcaactacttagcctggtaccagcagaaacctggccaggctcccaggctcctcatctatgctgcatccaccagggcccactgacatcccagaccaggtttcatttggcgctgggtctgggacagacttcactctcaccatcgagacactggacncctgactgtatttgcagtgtatcactgtcagctagtatgtactaattctaccttcttaacgtttcgggtacggtacgggaccgtaaggtacgaacgtacgtacgaaaacgacgtaggtcggacgttacgcaacccgtattacgtcgttacttacacttccttcccggtaccc

SEQ ID NO: 144113 - DNA, 782 bp, Homo sapiens
  misc_feature: GYAE6OF01CUBLC.42.81.H04.1.454.CMB.1.raw
  modified_base (187)..(187): a, c, t, g, unknown or other
  misc_feature (187)..(187): n is a, c, g, or t
  modified_base (220)..(220): a, c, t, g, unknown or other
  misc_feature (220)..(220): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccacggagaaattgtgttgacgcagtctccaggcatcctgtctttgtctccgaggggaaancgccaccctctcctgcagggccagtcgagggtntgacagactaactacttagcctggtaccagcaagaactggccaggcctcccgaggcctctacattctatcgctgcactcccacgacggccacgtcgaaccactacccgaagactaggtttcaggttcggccgtcgttgggtcgtacgggaactacgtacttccgaccttacgtaccaaccgtagtaccggaacgtaaccgtacggttacgggaacgttcccgtaaggttaacgttcggtttaacgtttttcgggaccgttaagggtttacgttaacgttacccgtacgttacggtaccgtacggtaacgtaagtttacgttacgtaacctttaaacgttcccgtaaacccgttttaccggttttaaaccgggtttaccgggggaaccggggtaaaccggggtaaacgttaaccgggggttacgtaaaccgtaaaccgttaaacccggaaaaccggttacggttacgggtacgggtaccttaccgggtaacctaaccccgttacgttacgtttaccggtttaccttaaccgttaccgtttcccccgttaccccggttaaaccc

SEQ ID NO: 144114 - DNA, 574 bp, Homo sapiens
  misc_feature: GYAE6OF01C39II.42.81.H04.1.454.CMB.1.raw
  modified_base (375)..(375): a, c, t, g, unknown or other
  misc_feature (375)..(375): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaagagccaccctctcctgcagggccagtcagggtgttgacagcaactacttagcctggtaccagcagaaacctggccaggctcccaggctcctcatctatgctgcactccaccgacgggccactgacactcccagacaggttcagttcggcgtcgtgggtctgggacagtacttcactctacaccatcganacacgtggacgcctagatgtatttgctagtgtatcacgtgtacagtctagtatgtacttaattcctaaccttacgttaaccgtttccggggtacgggtaacgggtaaccgtaagggtacggaactaacgtaacgaaaacgtaacgtggtacggctacgccaccgtactcgtcgttactactaccttccgttcccgtacc

SEQ ID NO: 144115 - DNA, 659 bp, Homo sapiens
  misc_feature: GYAE6OF01AZ0YW.42.81.H04.1.454.CMB.1.raw
  modified_base (187)..(187): a, c, t, g, unknown or other
  misc_feature (187)..(187): n is a, c, g, or t
  modified_base (218)..(218): a, c, t, g, unknown or other
  misc_feature (218)..(218): n is a, c, g, or t
  modified_base (304)..(304): a, c, t, g, unknown or other
  misc_feature (304)..(304): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattggtgttgacgcagtctccaggcatcctgtcttgtctccaggggaaangccaccctctcctgcagggccagtcagggtnttgacagcaactacttacgcctggtaccagcaagaacctggccaggcctcccgaggcctcctcattcctatgctcgcatcccacgngggccctacgtgaacactcccaagaccgtaggttcagttcggccgtcggtgggtcgtggactaggtaccttccgactctaccacagtccggacgactacgtcggaacgtcccttaggtattacggttagttttcgacgttagttacgttaactccgtaacgttcgtaccgaagtccgtagttacgtcgtacttaaacttcctacctttaccgttaacggtttccgggtaccgggtacgggtaaccgtagggtacgaacgtagtaaccgtaaacgtacgtacggtcggtacctacggtaccctaccgtagttccgttacgttaccttacgttacccttcccgttacccgtaacccg

SEQ ID NO: 144116 - DNA, 817 bp, Homo sapiens
  misc_feature: GYAE6OF01CWCSI.42.81.H04.1.454.CMB.1.raw
  modified_base (186)..(186): a, c, t, g, unknown or other
  misc_feature (186)..(186): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccacggagaaattgtgtgacgcagtctccaggcatcctgtctttgtctccaaggggaaangccaccctctcctgcgagggccagtcgagggtgttgacagactaactacgttagcctaggtaccagacaacgaaaaccgtcggacccgaaggtcctaccccgaaggtccctacccttacattacctatgaccgttcgacactacccaaccggaacgggacccaacgtcgacctaacgtaccccgaggtacgtaacgggtttcaagtttcgggcgtcggttcgggtccgtagggtaaccacggtacctttcgaaccttcccgtaacgtaaccctaagtaccggaagtaaccgtaacgtcgggaccgtaccgttaggtaatttaggtttaaacgtttttcggaaccgtaggtttaccggtaaattacccgtaacggttcgtaccgtacggtacgttaagttacgttacggttaacctttaaaccgttacccgttaaacctttaaccggttttaaacccggtttaccgggggaacccggggtaaacgggtaaacccgggtaacggtacgggtaacctaaacggtaaaccgaaaacggttaccgtggttaacgggaccttaccggaacctaacccgttagtttaccgtacggttttacccttaccgtacccgtttccccgttaccccgtaaaccg

SEQ ID NO: 144117 - DNA, 502 bp, Homo sapiens
  misc_feature: GYAE6OF02H3M13.42.81.H04.1.454.CMB.1.raw
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaagagccaccctctcctgcagggccagtcagggtgttgacagcaactacttagcctggtaccagcagaaacctggccaggctcccaggctcctcatctatgctgcatccaccagggccactgacatcccagacaggttcattggcgctgggtctgggacagacttcactctcaccatcgagacactgggacgcctgatgtattttgctagtgtatcactgtcagcagtatgctaattcacctctaactttcggcggagggaccaaggtgacatacaacgactgtggctgcaccatctgtcttctacttccttccgtcc

SEQ ID NO: 144118 - DNA, 497 bp, Homo sapiens
  misc_feature: GYAE6OF02IJ72K.42.81.H04.1.454.CMB.1.raw
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaagagccaccctctcctgcagggccagtcagggtgttgacagcaactacttagcctggtaccagcagaaacctggccaggctcccaggctcctcatctatgctgcatccaccagggccactgacatcccagacaggttcattggcgctgggtctgggacagacttcactctcaccatcgagacactggagcctgatgattttgctagtgtatcactgtcagcagtatgctaattcaccttactactttcggcggagggaccaaggtggacatacaacgactgtggctgcacatctgttcttcattcctccgcc

SEQ ID NO: 144119 - DNA, 550 bp, Homo sapiens
  misc_feature: GYAE6OF02GHBUL.42.81.H04.1.454.CMB.1.raw
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaagagccaccctctcctgcagggccagtcagggtgttgacagcaactacttagcctggtaccagcagaaacctggccaggctccaggctcctcatctatgctgcatccaccagggccactgacatcccagacaggttcattggcgctgggtctgggacagacttcactctcaccatcgagacacgtggacgcctgatgtattttgctagtgtatcactgtcagcagtatgtacttaacttctaccttacttaacgtttcgggacggtacgggtaccgtaaggtcggaactacgtaccgaacgtaacgttggtcggtactcggacctacctagttcgttcgttccttactacttcccttcccgtacc

SEQ ID NO: 144120 - DNA, 569 bp, Homo sapiens
  misc_feature: GYAE6OF02IEUP8.42.81.H04.1.454.CMB.1.raw
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaagagccaccctctcctgcagggccagtcagggtgttgacagcaactacttagcctggtaccagcagaaacctggccaggctcccaggcctcctcatctatgctgcatccaccagggccactgacatcccagacaggttcattggcgcgtgggtctgggacagacttcactctacaccatcgagaccacgtgggacgcctgatgtattttgctagtgtatctactgtacagctagtatgtactaacttctaccttacttaccgtttccgggacggtaacgggtaaccgtaagggtacggaacgtacgtacgaaaccgtaacgttacggtcggtacgtacgacctaccgtattccgttgttaccttactacttcccgttcccgtacc

SEQ ID NO: 144121 - DNA, 696 bp, Homo sapiens
  misc_feature: GYAE6OF02IBZ9M.42.81.H04.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (426)..(426): a, c, t, g, unknown or other
  misc_feature (426)..(426): n is a, c, g, or t
tcagtgacgtatgtcacgaccggtgctcgatttagtagtgtagattcgcggggagttaggaccgagagggaaccgatggaaacccagcgcagcttctcttcctcctcgctactctcggctcccagactaccaccggagaaacttggnttgacncagtcctcaggcatcctgtcttagtcctaccgaggggaacacggccaaccctcncctgcacgggccagtcagggtnttcgactagcaacttctancctggtacccagcagaaactggccaggcctccaggcctcnctatcctancgctgcatcccacacgggccacgtcgacacgtccccagacccaggttaccattcgggccgtctcggggttcacggggactaacgtaccgttanacctttcccgnaaacccctgtacccgaggtaacccncgttacgggaccgtccgtacgaactggtaaccgttttgaccttggtagtttacgtaccgtccgttagtaccgtaaacgtccgaaggtttactacgtacttaaaccttctaaacccttacgttaaaccgttccgggtaacgggttaacgggaacccgttaagggtacgtacgtaacgtaccgaaaccgtacgttacggacggtaccgtcggaacccgtaccgtaagttcccgtaggttccttacggtaacccttccgttacccgtaccccg

SEQ ID NO: 144122 - DNA, 497 bp, Homo sapiens
  misc_feature: GYAE6OF02JCK9X.42.81.H04.1.454.CMB.1.raw
  modified_base (344)..(344): a, c, t, g, unknown or other
  misc_feature (344)..(344): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaagagccaccctctcctgcagggccagtcagggtgttgacagcaactacttagcctggtaccagcagaaacctggccaggctcccaggctcctcatctatgctgcatccaccagggccactgacatcccagacaggttcattggcgctgggtctgggacngacttcactctcaccatcgagacactggagcctgatgattttgcagtgtatcactgtcagcagtatgctaattcacctcttaactttcggcggacgggaccaaggtgtaacatacaacgactgtggctgcaccatctcgtctcatcctccgac

SEQ ID NO: 144123 - DNA, 619 bp, Homo sapiens
  misc_feature: GYAE6OF02GPIC8.42.81.H04.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
tcagtgacgtatgtcacgaccggtgctcgatttagtagtgtagattcgcggggagttacggacccagagggaaccatggaaaccccagcgcagcttctcttcctcctgctactctggctcccagataccaccggagaaattgtgttgacgcagtctccgtaggcatcctgttctttgtctcaggggaaanagccaccctntccgtgcgacgggccagtcagggtgttgacgagcaactacttagcctggtaccagcagaaacctggccaggcctccaggcctcctnatctatgctgcactcccgaacgaggcccacgtgaccacgtccccaagtacctaggttacagtttcgggcgtacgtgggtcgtagggaaccaggtaccttcagtccgtcacctatcgacacacgtgggactccgtagaactgtacttttcggagtagttgtactactacgtgtactacgcgtagtagtgtactaacttccgaccttacgttaacgtttcgggtacggtaacggtaaccgtaaggtacggaacgtactacgaaacgtaacgtggtacggtacgtacgacctacgtacgtacgttcgtccgttactacgttcccgtacccgtaccg

SEQ ID NO: 144124 - DNA, 675 bp, Homo sapiens
  misc_feature: GYAE6OF02ID85B.42.81.H04.1.454.CMB.1.raw
  modified_base (186)..(186): a, c, t, g, unknown or other
  misc_feature (186)..(186): n is a, c, g, or t
  modified_base (218)..(218): a, c, t, g, unknown or other
  misc_feature (218)..(218): n is a, c, g, or t
tcagtgacgtatgtcacgaccggtgctcgatttagtagtgtagattcgcgggagttaggaccgagagggaaccatggaaacccagcgcagcttctcttcctcctgctactctggctcccagataccaccggagaaattgtgttgacgcagtctccgaggcatcctgtctttgtctccgagggaaanagccacctctcctgcagggccaggtcagggtnttgacagcaactacttagcctggtaccagcagaaacctggccaggctcccaggcctcctcatctatgctgcactaccaccgacggcctacgttcgaccacgtccccagtaccaggttcgacgttcggacgtcgttcgggtctagggactacggtaaccttcgacttcgtacaaccgtacgtcgaaggacctacgtacgggactccgtagtaacttggttaacgttttcgacgttagttacgtactcgtaacgttgtacgtaagtacgtaagtttactacgttacttaacttccgtaaccgttaccgtttaaccgttttaccggggacgggttaacgggtaacccgttaaagggtacggtaaccgttaacgtaccggtaaaacgtaccggtaggtcggtaacttcggaacctaccgtagttccgttacgttaccttaccgtacgttccctccgtaccg

SEQ ID NO: 144125 - DNA, 582 bp, Homo sapiens
  misc_feature: GYAE6OF02IQUQF.42.81.H04.1.454.CMB.1.raw
  modified_base (221)..(221): a, c, t, g, unknown or other
  misc_feature (221)..(221): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
tcagtgacgtatgtcacgaccggtgctcgatttagtagtgtagattcgcgggggagttaggacccagagggaaccatggaaaccccagcgcagcttctcttcctcctgctactctggctcccagataccaccggagaaattgtgttgacgcagtctccaggcatcctgtcttttgtctccaggggaaagagccaccctctcctgcagggccagtcagggtnttgacagcaactacttagcctggtaccagccagaaacctggccaggcctccaggctcctcatctatgctgcactccaccgaggccactgaccatccccagacaggttcagttcggcgcgtgggtcgtgggacagtcttcactctacacctatcgacgacacgtggacnctagatgtatttgctagtgtactctactcgtcgagcagttatntatacttctaccgttacttaccgttccggacggtacggacgtaagggtacgaactacgtaacgaacgtaacggtcggtacggtcctacggtaccgaccgttaacgttccgttcgttaccgttaccgtaactttcccgttacccgtacccg

SEQ ID NO: 144126 - DNA, 665 bp, Homo sapiens
  misc_feature: GYAE6OF02JOK1W.42.81.H04.1.454.CMB.1.raw
  modified_base (223)..(223): a, c, t, g, unknown or other
  misc_feature (223)..(223): n is a, c, g, or t
  modified_base (469)..(469): a, c, t, g, unknown or other
  misc_feature (469)..(469): n is a, c, g, or t
tcagtgacgtatgtcacgaccggtgctcgatttagtagtgtagattcgcggggagttaggacccagagggaaccatggaaacccagcgcagcttctcttcctcctgctactctggctcccagataccaccggagaaattgtgttgacgcagtctccaggcatcctgtctttgtctccagggaagagccaccctctcctgcagggccagtcgagggtgttgacngcacgtacttagcctggtaccagcagaaacctggaccaggctccaggctcctcatcatgctgcactccacgtacggcccacgtcgacactcccaggacctaggttccaagttcggacgcgttgggtcgtcggaacacggttaccttacctacgtccgttaccaaccgtaagtaccgaagtacccaacggtggaaccgtccgtacggattacggtattttcgataacggtgtaactccgtaacgttntaccgtgtactagttagtcgtacttaacttccctacctttacgttaacccgtttcgggacgggtaccgggtaaccgtaacgggtagacccgtaagttacccgtaacgtaaaccgttggtaacggttaccgtagggaccctaacctaacgttccgttacgtacctttacccggtactttcccgttacccgtaacccg

SEQ ID NO: 144127 - DNA, 687 bp, Homo sapiens
  misc_feature: GYAE6OF02H9MZU.42.81.H04.1.454.CMB.1.raw
  modified_base (218)..(218): a, c, t, g, unknown or other
  misc_feature (218)..(218): n is a, c, g, or t
  modified_base (397)..(397): a, c, t, g, unknown or other
  misc_feature (397)..(397): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaagagccacctctcctgcagggccagtcagggtnttgacagcaactacttagcctggtaccagcagaaactggaccaggcctccgagtcctctacatctatgctgcctactaccaccgacggccacgtgacctacctaccgaacgacgtcgttactacgttcggccgtcggttagggtccgtacgggactacgtacctcgacctcgtacacgntacgacactacgtgacgcctagtagttgtacgttttacgacgttacgtacgtacgttactacgtcgtacggtacgtacgttagttaccgtacgtaacttaacgttacccttaaccgttaccgtttaaccggttcggggtaaccgggtaacgggttaaccggtaaacgggtacgtaaaccgttaacgaaccgttaaaccggtacggttacggtcggtaccgtacgtacccgttaaccgttacgtaccgtttcgttaccgtttaccctacgttccccgttaccgttaacccg

SEQ ID NO: 144128 - DNA, 585 bp, Homo sapiens
  misc_feature: GYAE6OF02HI2E1.42.81.H04.1.454.CMB.1.raw
  modified_base (187)..(187): a, c, t, g, unknown or other
  misc_feature (187)..(187): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaanagccaccctctcctgcagggccagtcagggtgttgacagcaactacttagcctggtaccagcagaaacctggccaggctccaggctcctcatctatgctgcatccaccgagggcccacgtcgaccactccccgaggaccagggttcaattcgggcgtacgtggggtctagggactaggtaccgttcactctacaccagtccgaagccacgtgggactccgtagactgtattttcggactagttgtactctactgtactagctagtatagtactacttcctaaccttacgttaacgttccggacgggacggtaaccgtaaggtcgaacactaaccgaacgtacgttaggtacggtctcgactaccacgttctacgttccttactcttccgtaccctacc

SEQ ID NO: 144129 - DNA, 594 bp, Homo sapiens
  misc_feature: GYAE6OF02G4D4J.42.81.H04.1.454.CMB.1.raw
tcagtgacgtatgtcacgaccggtgctcgatttagtagtgtagattcgcgggggagttaggacccagagggaaccatggaaaccccagcgcagcttctcttcctcctgctactctggctcccagataccaccggagaaattgtgttgacgcagtctccaggcatcctgtctttgtctccaggggaaagagccaccctctcctgcagggccagtcagggtgttgacagcaactacttagcctggtaccagcagaaacctggccaggctccaggctcctcatctatgctgcactcccacgagggccacgtcgacactcccagacgtaggttcagttcggcgtcgtgggtctaggacagtacttcgactctacacagtcgacactacgtgacgtcgtgatgtagtttgagtacgttgtactcgtactgtcgtacgcgtagtatcgtactacttacctaccgttacgttaaccgttcgggacgggtaaccgggtacgtaacgggtacggactaacgtaacgaacgtaacgtcggtacggtcgttaccgcgtaccgtaacgttcgttacgttaccttccgtactttcccgtccctaccg

SEQ ID NO: 144130 - DNA, 645 bp, Homo sapiens
  misc_feature: GYAE6OF02HCK5C.42.81.H04.1.454.CMB.1.raw
  modified_base (376)..(376): a, c, t, g, unknown or other
  misc_feature (376)..(376): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtcttttgtctccaggggaaagagccaccctctcctgcaggccagtcagggtgttgacagcaactacttagcctggtaccagcaacgaaaccgtggccaggctccccaggctcctcatctatcgctgcatcccaccgacggccactgacatcccgagacaggttcagttggcgtcgtgggtctgggacagacttcactctcaccatcganacctacgtgggctcctagagttgttagttttggcgtaggtgtaacttccgtaacgttgtacgagtacctagttacgtacgtaccttaatttcccgaaccctttacgtttaaaccggtttcgggacccgggtaagggtaacccgggtaacggttacggaactaacgtaacccgtaaaggaccgtttacgggtacgtccgtacgtacccgtaacccgtacgtttaccgttcgtttcccttaaccgtactttccccggttaccccgtacccg

SEQ ID NO: 144131 - DNA, 617 bp, Homo sapiens
  misc_feature: GYAE6OF02GCN20.42.81.H04.1.454.CMB.1.raw
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtcttttgtctccgaggggaaagagccaccctctcctgcgagggccagtcgagggtgttgacagcaactacttacgcctaggtaccagcaacgaaacctggaccaggcctccgaggtcctcctcactctatgctcgctactccgaccgacgggccacgtcgaccactcccaaggtactacggttacagttggcgtcgtgggtcgtggacagtacttctaactctacacctagcgagacacgtgacgccgtgattgtatttgctagtgttacgtctacgtgtcagtactagttagtcgtacttaacttcctaaccgttcgttacgtttacgggtacgggtacggtaaccgaggttacggaactaacgtaacgaacgtacgtcggtggtaccgtacgaccgtaacgtagttccttacggttaccttccgtaacgtttcccgtacccgtacccg

SEQ ID NO: 144132 - DNA, 701 bp, Homo sapiens
  misc_feature: GYAE6OF02IKIWH.42.81.H04.1.454.CMB.1.raw
  modified_base (188)..(188): a, c, t, g, unknown or other
  misc_feature (188)..(188): n is a, c, g, or t
  modified_base (220)..(220): a, c, t, g, unknown or other
  misc_feature (220)..(220): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccgaggggaaanacgccacctctcctgcagggccagtcagggtnttgacagcaactacttagccgtggtaccagcaacggaaacctggccaggcctacccgaggccttccgtacctatcctagtcgctggccactcccgaccgtacgggccctacgtcgaaccacgtaccccaaggaccgtaaggttttcagtttcgggcgtcgggttcggtcgttacgggacctaacgtacctttacacgttcctacgtaaccctagtaccggaacgtacctacggttacggaaccttccgtacgtagtacgtttaagtttcgacgtaggtttagtacttactacgttcgtacgtagtccgtaagttacttacgtactaaccttctaaccttaccgttacggtttacggggaacggtaacgggaaccgtaaggtacgacttaacgtacgtaaacggtacttcggaggttaccgtacggaccttaacgtagttaccgttacggttaccttacgtaccttcccgtacccgttaccg

SEQ ID NO: 144133 - DNA, 619 bp, Homo sapiens
  misc_feature: GYAE6OF02GRXYJ.42.81.H04.1.454.CMB.1.raw
  modified_base (188)..(188): a, c, t, g, unknown or other
  misc_feature (188)..(188): n is a, c, g, or t
  modified_base (221)..(221): a, c, t, g, unknown or other
  misc_feature (221)..(221): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccgaggggaaangccaccctctcctgcgagggccagtcgagggtnttgacagctaactacttagcctaggtaccagcaacgaaacctggccaggcctcccgaggcctcctcactctatgctgctactcccaccgagggccctacgtcggaccactaccccaagtaccaggttcagttcggcgtcgttcgggtccgtgggaaccaggtaccttacacttcctaccgaacctagtcgaacgacctacggtacgggacgtaccgtgtaacgttgttacgttttacgcgtacgtagtactactacgtcgtactagtactagttatcgtactattcctactacgttacgtcggacggaggtaccgtaggtacgtaacgtacgtacgaacgtacgtcggtaggactgacctactacgtcttacgtccttacgtcttcccgtccgtaccg

SEQ ID NO: 144134 - DNA, 682 bp, Homo sapiens
  misc_feature: GYAE6OF02GVG66.42.81.H04.1.454.CMB.1.raw
  modified_base (247)..(247): a, c, t, g, unknown or other
  misc_feature (247)..(247): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctccaggggaaagagccaccctctcctgcgagggccagtcagggtgtgacagcaactacttagcctggtaccngcaagaaacctggccaggcctcccgaggcctcccncacgtctatnctgcctactcccaccgacgggaccacgtacggaaccaccgtaccccgtaaggactaggtttaccaggttcggaccgcgttgggtccgtaggacagtactctactctacacctagtacgacacctacgtcggactccgtgtacgttgttagttttacgcgtaggttacgttactacgtccttacggtacgtacgaacgttaaggttacgttacgtaaccgtttaactttccgtaaaccctttacggtttaaccgttacgggtaaccgggtaacggggtaacccgtaagggttacgtaacgacgtaaccgtaacggtaacgtggtacggtcgtacgtacccgaacgttaccgtacgttcggttccttacgtaccgttcccttacccgtaccg

SEQ ID NO: 144135 - DNA, 651 bp, Homo sapiens
  misc_feature: GYAE6OF02G17EL.42.81.H04.1.454.CMB.1.raw
  modified_base (186)..(186): a, c, t, g, unknown or other
  misc_feature (186)..(186): n is a, c, g, or t
tcagtgacgtatgtcacgaccggtgctcgatttagtagtgtagattcgcggggagttaggacccagagggaaccatggaaaccccagcgcagcttctcttcctcctgctactctggctcccagataccaccggagaaattgtgttgacgcagtctccaggcatcctgtctttgtctcaggggaaangccacctctcctgcgaggccagtcagggtgttgacagcaactacttagcctggtaccagcagaaacctggccagcctccaggctctcatctatgctgcactccaccgaggccactgacactccagacgtaggttcagttcggcgtcgtgggtcgtaggactagacttacgacctctaccactagttaccgaagacgacgttggaacgtccgtagtaagttacgttagttttacgacgtaggttacgtacttacgtaactacgtacgtaacgcgttaacgttataacgttacttaaaccgttctaacccgttacggtttaaacccggtttcgggaacgggtaaccgggttaaccgtaaacgggtacgtaaacgaacgtaaccggtaaacgttaacggtcgtaacggtacctcggtaacctaccgttataccgttcttaccgttacctacttacccgttcctaaccg

SEQ ID NO: 144136 - DNA, 349 bp, Homo sapiens
  misc_feature: GYAE6OF01EQSZ4.29.8.A08.1.454.CMB.1.raw
  modified_base (341)..(349): a, c, t, g, unknown or other
  misc_feature (341)..(349): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctattctacgacggtatggacgtctggggccaagggaccacggtcgccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnnnnnnnnn

SEQ ID NO: 144137 - DNA, 346 bp, Homo sapiens
  misc_feature: GYAE6OF01CQXXY.29.8.A08.1.454.CMB.1.raw
  modified_base (342)..(346): a, c, t, g, unknown or other
  misc_feature (342)..(346): n is a, c, g, or t
tcagatagagtactcacgaccggtgctcgatttagcatactctacagggacaacgccaagaactcactgtatctgcaaatgaaccgcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnnnnn

SEQ ID NO: 144138 - DNA, 347 bp, Homo sapiens
  misc_feature: GYAE6OF01B5CPF.29.8.A08.1.454.CMB.1.raw
  modified_base (342)..(347): a, c, t, g, unknown or other
  misc_feature (342)..(347): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnnnnnn

SEQ ID NO: 144139 - DNA, 345 bp, Homo sapiens
  misc_feature: GYAE6OF01B9F8E.29.8.A08.1.454.CMB.1.raw
  modified_base (341)..(345): a, c, t, g, unknown or other
  misc_feature (341)..(345): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctattctacgacggtatggacgtctggggccaagggaccacggtcgccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnnnnn

SEQ ID NO: 144140 - DNA, 413 bp, Homo sapiens
  misc_feature: GYAE6OF01DY9NW.29.8.A08.1.454.CMB.1.raw
  modified_base (286)..(286): a, c, t, g, unknown or other
  misc_feature (286)..(286): n is a, c, g, or t
  modified_base (401)..(413): a, c, t, g, unknown or other
  misc_feature (401)..(413): n is a, c, g, or t
tcagatagagtactcacgaccggtgctcgatttagcatactctacagggacaacgccaagaactcactgtatctgcaaatgaacagcctgagagccgagacgacggccgtatattactgtgcgagtagttactccctcgacggtgaacaatcgcttatttctacggacgtagtggacgtcgtcggggaccgaacgggacctacggtccgccgtcctcctcacgccctcccaaccgaacgggcccagtccggttcccttcccccgtggccgccctgcctccgaggcnccacctccgagacgcaacacggccggtcccgtgggctcgccgtggtacgaaggaccttaccttccgtacgatccggtcgtctggacggcgggctggacaacgggcgacaagtagnnnnnnnnnnnnn

SEQ ID NO: 144141 - DNA, 370 bp, Homo sapiens
  misc_feature: GYAE6OF01DHGKI.29.8.A08.1.454.CMB.1.raw
  modified_base (260)..(260): a, c, t, g, unknown or other
  misc_feature (260)..(260): n is a, c, g, or t
  modified_base (341)..(341): a, c, t, g, unknown or other
  misc_feature (341)..(341): n is a, c, g, or t
  modified_base (347)..(370): a, c, t, g, unknown or other
  misc_feature (347)..(370): n is a, c, g, or t
tcagatagagtactcacgaccggtgctcgatttagcatactctacagggacgaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagccctccaccaagggcccatcggtccttccccctggcgccctgctccaggancactccgagagcacagccggcctgggctgcctggtccaaggactacttcctatacgatcgctgagcgggctgggcaaggcncatagnnnnnnnnnnnnnnnnnnnnnnnn

SEQ ID NO: 144142 - DNA, 345 bp, Homo sapiens
  misc_feature: GYAE6OF01DM0XA.29.8.A08.1.454.CMB.1.raw
  modified_base (255)..(255): a, c, t, g, unknown or other
  misc_feature (255)..(255): n is a, c, g, or t
  modified_base (341)..(345): a, c, t, g, unknown or other
  misc_feature (341)..(345): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaaggcccatcggtcttcccctggcgccctgctccaggancacctccgagagcacagcggccctgggctgcctggtcaaggactacttcctcgatcgcgtctgagcgggctggcaaggcgcatagnnnnn

SEQ ID NO: 144143 - DNA, 346 bp, Homo sapiens
  misc_feature: GYAE6OF01EAU9U.29.8.A08.1.454.CMB.1.raw
  modified_base (344)..(346): a, c, t, g, unknown or other
  misc_feature (344)..(346): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggccgccctgctccaggagcacctccgagagcacagccggccctgggctgcctggtcaaggactactcctcgatcgcgtctgagcgggctggcaaggcgcatagnnn

SEQ ID NO: 144144 - DNA, 351 bp, Homo sapiens
  misc_feature: GYAE6OF01BXWZG.29.8.A08.1.454.CMB.1.raw
  modified_base (345)..(351): a, c, t, g, unknown or other
  misc_feature (345)..(351): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttcccctggccgccctgctccaggagccacctccgagacgcacagcggccctgggctgcctggtcaaggactacttcctatacgatcgctgagcgggctggcaaggcgcatagnnnnnnn

SEQ ID NO: 144145 - DNA, 341 bp, Homo sapiens
  misc_feature: GYAE6OF01A130H.29.8.A08.1.454.CMB.1.raw
  modified_base (340)..(341): a, c, t, g, unknown or other
  misc_feature (340)..(341): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtctcccctggcgccctgctccaggagcacctccgagagcacagcggccctgggctgcctggtcaaggactacttccatacgatcgctgagcgggctggcaaggcgcatagnn

SEQ ID NO: 144146 - DNA, 354 bp, Homo sapiens
  misc_feature: GYAE6OF01DQWYC.29.8.A08.1.454.CMB.1.raw
  modified_base (347)..(354): a, c, t, g, unknown or other
  misc_feature (347)..(354): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtccttcccctggcgccctgcctccaggagcacctccgagagcacagcggccctgggctgcctggtcaaggactaccttccgagtagtacactggagcgggctgggcaaggcgcatagnnnnnnnn

SEQ ID NO: 144147 - DNA, 347 bp, Homo sapiens
  misc_feature: GYAE6OF01BKCM2.29.8.A08.1.454.CMB.1.raw
  modified_base (345)..(347): a, c, t, g, unknown or other
  misc_feature (345)..(347): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaaggggaccacggtcgccgtctcctcagcctccaccaagggcccatcggtcttccccctggccgccctgctccaggagcacctccgagagcacagcggccctggggctgcctggtcaaggctacttcctatacgatcgctgagcgggctggcaaggcgcatagnnn

SEQ ID NO: 144148 - DNA, 473 bp, Homo sapiens
  misc_feature: GYAE6OF01CIQ1H.29.8.A08.1.454.CMB.1.raw
  modified_base (418)..(473): a, c, t, g, unknown or other
  misc_feature (418)..(473): n is a, c, g, or t
tcagatagagtactcacgaccggtgctcgatttagcatactctacagggacaacgcctaagggaactcacgtggtatctgcaaatggaacagccctgagaggcccgagggacacggccgtattatttacctgtcgccgagagttatcccgtcaacgggtggaccaagtccgcttatttctaccgacggtactgggaccgtcgtgggggcccaaggggaccacgggtcgcccgtctcctcgagcctccaaccaaggggccccaattccggttccttcccccgtgggccgccccgttgacctccgagggacgcctaccgtcccgtagagccacacgccggccctggggactacgccctgggtaccaaaccggactacttcctcgattcgcgtctgagcgggctcggcaagggcgcatagnnnnnnnnnnnnnnnnnnnnnnnnnnnnnnnnnnnnnnnnnnnnnnnnnnnnnnnn

SEQ ID NO: 144149 - DNA, 342 bp, Homo sapiens
  misc_feature: GYAE6OF01EWC31.29.8.A08.1.454.CMB.1.raw
  modified_base (341)..(342): a, c, t, g, unknown or other
  misc_feature (341)..(342): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctccgagagcacagcggccctgggctgcctggtcaaggctacttcctcgatcgcgtctgagcggctggcaaggcgcatagnn

SEQ ID NO: 144150 - DNA, 353 bp, Homo sapiens
  misc_feature: GYAE6OF01CLD2L.29.8.A08.1.454.CMB.1.raw
  modified_base (349)..(353): a, c, t, g, unknown or other
  misc_feature (349)..(353): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtcgtggggccaagggaccacggtcgccgtctcctcagcctccaccaagggcccatcggtccttccccctggccgccctgcctccaggcgccacctccgagagcacagcggccctgggctgcctggtcaaggactacttcctcgatcgcgtctgagcgggctgggcaaggcgcatagnnnnn

SEQ ID NO: 144151 - DNA, 394 bp, Homo sapiens
  misc_feature: GYAE6OF01A7IXE.29.8.A08.1.454.CMB.1.raw
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
  modified_base (381)..(394): a, c, t, g, unknown or other
  misc_feature (381)..(394): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtcgtggggccaagggaccacggtcgccgtcctcctcagcctccaccgaagggccccatccggtccttcccccgtggccgcccctgcctccagggacgccacctccgagacgcacagcgaccgtccggnggcncgtcgtcgacgacgtaccttcctccgacgtcgtcgccgtgnggcgggcggtcgcggaacggacggccacgtaagngnnnnnnnnnnnnnn

SEQ ID NO: 144152 - DNA, 408 bp, Homo sapiens
  misc_feature: GYAE6OF01BGWDK.29.8.A08.1.454.CMB.1.raw
  modified_base (394)..(408): a, c, t, g, unknown or other
  misc_feature (394)..(408): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagccctccaccaagggcccagtcggtccttcccccgtggccgcccctgcctccagggacgccacctccgagagcaacagccggcccctggggctcgcccgttgggtaccaaacgggtaccttaccgtttccctcggacgttccggcgttctggacggccggggctgggccaaagggccgacgatacgnnnnnnnnnnnnnnn

SEQ ID NO: 144153 - DNA, 359 bp, Homo sapiens
  misc_feature: GYAE6OF01AOBL6.29.8.A08.1.454.CMB.1.raw
  modified_base (350)..(359): a, c, t, g, unknown or other
  misc_feature (350)..(359): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaaggcccatccggtcttccccctggcacccctcctccaagacgcaccctcgtgggggcacagccggccctgggctcgcctggtcaggacctacttccgcgatcgcgtctgagcgggctggacaaggcgcatagnnnnnnnnnn

SEQ ID NO: 144154 - DNA, 493 bp, Homo sapiens
  misc_feature: GYAE6OF01CMREH.29.8.A08.1.454.CMB.1.raw
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (429)..(430): a, c, t, g, unknown or other
  misc_feature (429)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (438)..(439): a, c, t, g, unknown or other
  misc_feature (438)..(439): n is a, c, g, or t
  modified_base (441)..(493): a, c, t, g, unknown or other
  misc_feature (441)..(493): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatcccctcacggtgacaatcgctatttctacgacggtatggacgtcgtggggccaagggaccacggtcgccgtctcctcacgccctccaccgaagggcccatcggtccttccccctggccgccctgcctccgaggacgccacctccgagacgcacgaggccggccctggggccttcggcccgtgggtaccgaaagggtaccttacctttccccgtcgaacgttccggtccggttcgtggaacgggtccggggcccttaggggacccgaaaggggtcccgacgtaaacgttaggngagngnngngncngnngnnnnnnnnnnnnnnnnnnnnnnnnnnnnnnnnnnnnnnnnnnnnnnnnnnnnn

SEQ ID NO: 144155 - DNA, 347 bp, Homo sapiens
  misc_feature: GYAE6OF02HV6UT.29.8.A08.1.454.CMB.1.raw
  modified_base (343)..(347): a, c, t, g, unknown or other
  misc_feature (343)..(347): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctccgagagcacagcggccctgggctgcctggtcaaggactacttcctcgatcgcgtctgagcgggctggcaaggcgcatagnnnnn

SEQ ID NO: 144156 - DNA, 349 bp, Homo sapiens
  misc_feature: GYAE6OF02FFXHI.29.8.A08.1.454.CMB.1.raw
  modified_base (347)..(349): a, c, t, g, unknown or other
  misc_feature (347)..(349): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggccccatcggtcttcccccctggccgccctgctcccaggagccacctccgagagcacagcggccctgggctgcctggtcaaggactacttccatacgatcgctgagcgggctggcaaggcgcatagnnn

SEQ ID NO: 144157 - DNA, 372 bp, Homo sapiens
  misc_feature: GYAE6OF02J1YAG.29.8.A08.1.454.CMB.1.raw
  modified_base (330)..(330): a, c, t, g, unknown or other
  misc_feature (330)..(330): n is a, c, g, or t
  modified_base (357)..(358): a, c, t, g, unknown or other
  misc_feature (357)..(358): n is a, c, g, or t
  modified_base (360)..(362): a, c, t, g, unknown or other
  misc_feature (360)..(362): n is a, c, g, or t
  modified_base (364)..(372): a, c, t, g, unknown or other
  misc_feature (364)..(372): n is a, c, g, or t
tcagatagagtactcacgaccggtgctcgatttagcatactctacaggacaacgccaagaactacactgtatctgcaatagaacagcctgagagccgaggacacggccgtatattactgtgcgagagttatccctcacggtgacaatcgctattctacgtacggtatggacgtctggggccaagggaccacggtcgccgtctcctcagcctccaccaacgggcccatcggtcttccccctggccgccctgactccgaggacgccacctccgagacgcacacgcggccctagggcctgccctggcaacggctacgtcctcgatccgcgtcngacgcggctggccaaggcgcatagcgnngnnntnnnnnnnnn

SEQ ID NO: 144158 - DNA, 350 bp, Homo sapiens
  misc_feature: GYAE6OF02GXQAT.29.8.A08.1.454.CMB.1.raw
  modified_base (343)..(350): a, c, t, g, unknown or other
  misc_feature (343)..(350): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctcctagagcacagcggccctgggctgcctggtcaaggactacttcctcgatcgcgtctgagcgggctggcaaggcgcatagnnnnnnnn

SEQ ID NO: 144159 - DNA, 347 bp, Homo sapiens; identical to SEQ ID NO: 144155
  misc_feature: GYAE6OF02GXK5W.29.8.A08.1.454.CMB.1.raw
  modified_base (343)..(347): a, c, t, g, unknown or other
  misc_feature (343)..(347): n is a, c, g, or t

SEQ ID NO: 144160 - DNA, 354 bp, Homo sapiens
  misc_feature: GYAE6OF02F7511.29.8.A08.1.454.CMB.1.raw
  modified_base (336)..(336): a, c, t, g, unknown or other
  misc_feature (336)..(336): n is a, c, g, or t
  modified_base (342)..(354): a, c, t, g, unknown or other
  misc_feature (342)..(354): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctccgagagcacagcggccctgggctgcctggtcaaggactacttcctcgatcgcgtctgagcggctggcaaggcncatagnnnnnnnnnnnnn

SEQ ID NO: 144161 - DNA, 386 bp, Homo sapiens
  misc_feature: GYAE6OF02I8QWC.29.8.A08.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (363)..(364): a, c, t, g, unknown or other
  misc_feature (363)..(364): n is a, c, g, or t
  modified_base (366)..(386): a, c, t, g, unknown or other
  misc_feature (366)..(386): n is a, c, g, or t
tcagatagagtactcacgaccggtgctcgatttagcatactctacaggggacaacgccagaactcactgtatctgcaaatgaacagcctggacgagccgagggaccacggccggtatacttactgtgcgagagttatccctcacggtgacaatcgctatttctacgacggtatcggacgtcgtggggccaagggaccacgggtcgccgtctcctcaggcctccaccgaagggcccatccggtccttccccctggccgccctgctccaggactcaacctccgagtaacgcacaggcgccctagggctggcctgtcgaagctaccttctcgatcgctntgacncgggctggctaaggcgcaatgnngnnnnnnnnnnnnnnnnnnnnn

SEQ ID NO: 144162 - DNA, 401 bp, Homo sapiens
  misc_feature: GYAE6OF02GL11N.29.8.A08.1.454.CMB.1.raw
  modified_base (383)..(401): a, c, t, g, unknown or other
  misc_feature (383)..(401): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtcgtggggccaaggggaccacggtcgccgtctcctcagcctccaccaagggcccagtcggtccttcccccgtggccgccctgcctccgaggacgccacctccgagacgccacgagccggccctgggcctgccgttgggtaccaaaggaccttaccgttccggaagttacgtaccacgtggacggccgggctgggacaagggcgacataggnnnnnnnnnnnnnnnnnnn

SEQ ID NO: 144163 - DNA, 433 bp, Homo sapiens
  misc_feature: GYAE6OF02GM7VV.29.8.A08.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (331)..(331): a, c, t, g, unknown or other
  misc_feature (331)..(331): n is a, c, g, or t
  modified_base (369)..(370): a, c, t, g, unknown or other
  misc_feature (369)..(370): n is a, c, g, or t
  modified_base (372)..(374): a, c, t, g, unknown or other
  misc_feature (372)..(374): n is a, c, g, or t
  modified_base (377)..(377): a, c, t, g, unknown or other
  misc_feature (377)..(377): n is a, c, g, or t
  modified_base (379)..(433): a, c, t, g, unknown or other
  misc_feature (379)..(433): n is a, c, g, or t
tcagatagagtactcacgaccggtgctcgatttagcatactctacagggacaacgccaagaactcactgtatctgcaaatgaacagcctgagagccgaggacacggccgtatattactgtgcgagagttatccctcacggtgacaatcgcttatttctacgacggtatggacgtctgggggccaaaggggaccacgggtcgcccgtcgtcctcagccctccaccaaggggccccatccggtccttcccccnggccnccctgcctccaggacnccacccttccgagtagcgacacgcgggcccctgggctgcctggtcaaggactacttccncgatcgcgtctgaggcggctgggcaagggcgcagtcgnngnnngcngnnnnnnnnnnnnnnnnnnnnnnnnnnnnnnnnnnnnnnnnnnnnnnnnnnnnnnn

SEQ ID NO: 144164 - DNA, 288 bp, Homo sapiens
  misc_feature: GYAE6OF01DJIG0.33.18.B07.1.454.CMB.1.raw
  modified_base (281)..(288): a, c, t, g, unknown or other
  misc_feature (281)..(288): n is a, c, g, or t
tcagtacacacactcacgaccggtgctcgatttagtcgctgcgtaaggggagttagaacggctgaagggtatagcactggctactatcggatgttctcctttgactactggggcccgggaaccctgatcaccgtctcctcggcctccaccaagggcccatcggtcttccccctggcaccctcctccaagagcacctctgggggcacagccggcctgggctgcctggtcaaggactacttccagtgtgtgtactgacgcgggctggacaaggcgcaataggnnnnnnnn

SEQ ID NO: 144165 - DNA, 301 bp, Homo sapiens
  misc_feature: GYAE6OF02JXI5X.33.18.B07.1.454.CMB.1.raw
  modified_base (261)..(261): a, c, t, g, unknown or other
  misc_feature (261)..(261): n is a, c, g, or t
  modified_base (286)..(301): a, c, t, g, unknown or other
  misc_feature (286)..(301): n is a, c, g, or t
tcagtacacacactcacgaccggtgctcgatttagtcgctgcgtaagggagttagaacggctgaagggtatagcactggctactataggatgttctcctttgactactggggcccgggaaccctgatcaccgtctcctcgcctccaccaagggcccatcggtccttccccctggccaccctcctccaagacgccacctcgtgggggccaacgagccggcccgtggctcgcctggtcaaggactacttccagtgtgtgtacnggagcggtctggcaggctcatacgnnnnnnnnnnnnnnnn

SEQ ID NO: 144166 - DNA, 505 bp, Homo sapiens
  misc_feature: GYAE6OF01CTIFE.12.57.F02.1.454.CMB.1.raw
  modified_base (290)..(290): a, c, t, g, unknown or other
  misc_feature (290)..(290): n is a, c, g, or t
  modified_base (423)..(423): a, c, t, g, unknown or other
  misc_feature (423)..(423): n is a, c, g, or t
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactacctcgcatcgcctggcatcaacaacagccaagagacgggccctgatacttgatgattgtaacngtgatggcagccaacgaacgaagggggacggatcccgtgactcgcttctcgaggctcgtagttcgtggggctggacgcgcctacctcacctatcctccagccctcagtctagaggatggagctagactattcngtacagaccgtgggcacgtgctagttgtggtagtcggaggaggacgagcgtggccgtcgtggcacgccaggctcgccccgtg

SEQ ID NO: 144167 - DNA, 550 bp, Homo sapiens
  misc_feature: GYAE6OF01A2YHV.12.57.F02.1.454.CMB.1.raw
  modified_base (290)..(290): a, c, t, g, unknown or other
  misc_feature (290)..(290): n is a, c, g, or t
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactaccttcgccatcgcctggcatcaacaacagccagagagggcctgatacttgatgattgttaacngtgatggcagccacaacgaagggggacggatccctgactcgcttctcaggctccgagttctggggctagacgcgctaccgtcacctatcctccacgtccctccagtcctggaggatggaacggtctacgacttagttactcgtacgacgaccgttggggactacgtggcctagtttggtacggttagtcgggacgggagggtacgaggcctcggaccggttcgtgggtcacggtcccgaaggcctccgcccccgttacgg

SEQ ID NO: 144168 - DNA, 655 bp, Homo sapiens
  misc_feature: GYAE6OF01C7QW4.12.57.F02.1.454.CMB.1.raw
  modified_base (298)..(298): a, c, t, g, unknown or other
  misc_feature (298)..(298): n is a, c, g, or t
  modified_base (424)..(424): a, c, t, g, unknown or other
  misc_feature (424)..(424): n is a, c, g, or t
tcagatacgacgtacacgaccggtgctcgatttagctcgatatagttgggtttgggggagagctctggggagtctgcaccatggcttggaccccactcctcttcctcaccctcctcctccactgcacagggtctctctcccaacttgtggtgactcaatcgccctctgcctctgccttctcgtgggacgcctcggtcaagctcacctgcactctgagcagtggcacactaccttcgcatccgcctggcatcaaacaacacgccagaggcgggcctcgatactgatgtatttgtaaacngtgatcggacacgaccaacgaacggaagggggacggtactcccgtagacgtcgtcttcgtacgacgtctaccgtagttcggtaggggctggacggccgtacctaccgtcgacctactccgtacccncggtaccctcgagttcacgggagactggaggtcgtatacctttagtacgttcgtaccgaggtacccgggttcgggacctacggttacggtcttagggtttcgggtacggtacggttcggggacggggtaacgggtaacggtaacggtcccggttacgggtaaccccgggttcggtacgggtaccgtaaccgggacccggtaacgggtcccgtcccggtcccccggttacgg

SEQ ID NO: 144169 - DNA, 639 bp, Homo sapiens
  misc_feature: GYAE6OF01EKRXU.12.57.F02.1.454.CMB.1.raw
  modified_base (341)..(341): a, c, t, g, unknown or other
  misc_feature (341)..(341): n is a, c, g, or t
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcaggtgggcacacctaccttcgccatcgcctggcatacaacaacacgccaggagacgggccctacgatacttgatgtattgttaacaggtgagtgacacgaccaagaacggaagggggacggactccngtactcgcttctcgacggtctaccgtaggttcgtggggtctggacgccgtacctacctaccacctactccctaccacgtcccctccgtagtcctagggacggtagtacgggacgtctaggaacctttagttacccgttgtaccgaacgggtacccggtcggggactacggttggtacttaggtttgggttaacgggttacggtccggggaacgggaacgggtaacggaacgtcgtaccgggacccggttcgggtagggaccgacggacccgaacgggtcctcccggcccccggttacg

SEQ ID NO: 144170 - DNA, 643 bp, Homo sapiens
  misc_feature: GYAE6OF01B6I43.12.57.F02.1.454.CMB.1.raw
  modified_base (304)..(304): a, c, t, g, unknown or other
  misc_feature (304)..(304): n is a, c, g, or t
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (477)..(477): a, c, t, g, unknown or other
  misc_feature (477)..(477): n is a, c, g, or t
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctcgtgggagcctcggtcaagctcacctgcactctgagcagtggcacactaccttcgccatccgcctggcatacaacaacacgaccaggacggacggggccctcgatacgttgatgtatttagtaacngtgaagtggacagaccgaacgaaacgggaagggggacggactcccgtagactcgtcttcgacgacggtcctccgtagttcggngggtctggacgtccgcctaccncgaacctctccnccacgtccctaccnggtctaggaggtcgtggacgtcgtacgtactttacgttacgngtaccgaacgtaccggttcgggacctacgtgggtacttaggtttcggaggtttaccggtcggggaccgggtaaaggggacgtaacgtccggtacgggtaccccggttcggtacggggtacccaccggggacccctagggtccccttcccgggtcccccgtttacgg

SEQ ID NO: 144171 - DNA, 831 bp, Homo sapiens
  misc_feature: GYAE6OF01BSEAY.12.57.F02.1.454.CMB.1.raw
tcagatacgacgtacacgaccggtgctcgatttagctcgatatagttgggtttgggggagagctctggggagtctgcaccatggcttggaccccactcctcttcctcaccctcctcctccactgcacagggtctctctcccaacttgtggtgactcaatccgggggggccctctcgcctctcgcctctcgtgggacgccgtcggtcaacgctcacctcgcactctgagcgaggtcggacactacctaccttccgccacgtcgccgtcggacactacaaacaaacacgaccgaaggacggaccggggacccgtacggtaacttaccgttaggtacgttaggtaagtttaacggtttaaaaccgtaggttacggtagttacggacgaacggaacccgaaacggaaaacgggaaacgggggggaaccgggtaccgtacccgtacggtacgtcgtccttcgtacgacggtccgtaccgtacggttcggtcggggtacgtacggtacggtccgtacctacctacccgaacctaccttcccgtacccgaccgtaccccgttaccgtaacggttccgtaacgggtaaggtacgttacgggaacggttctttacggtaactttaacgttttaccggtacgtaccgtaacgggtacccgggttacggggacctacgggttcggtacgttagggttcgggttacgggttacggttccggggaacgggggtaacgggtaaccggacggtaccgggttacccgggtcccggttaccgggttacggggacccgtaaccgggacccccgtaagggtccccggttccccggtccccccggttacgg

SEQ ID NO: 144172 - DNA, 837 bp, Homo sapiens
  misc_feature: GYAE6OF01DSOKA.12.57.F02.1.454.CMB.1.raw
  modified_base (154)..(154): a, c, t, g, unknown or other
  misc_feature (154)..(154): n is a, c, g, or t
  modified_base (219)..(219): a, c, t, g, unknown or other
  misc_feature (219)..(219): n is a, c, g, or t
tcagatacgacgtacacgaccggtgctcgatttagctcgatatagttgggtttgggggagagctctgggggagtctgcaccatggcttggaccccactcctcttcctcaccctcctcctccactgcacagggtctctctcccaacttggtggtnactcaatccgccctctgcctctcgcctctctgggagcctcggtcaagctcacctgccactctgancagtggccacactacctcgcatcgctgcatacaacaacagccagaacgcggggcctcgactacgttgacttgaagtttacgtaaacaggtagagtacggacgacggacccaacgaaacgggaaggggggaccggtaactcccgtagactcggtcttctacgacggtccgtacccgtaggtttccggtcgggggtctacgggacgaccggtcccttaacccgcctaaccgtacctcccgtaccccgtacgcccccgttacccgtacggtttacccgtaggggtaacgggttacgttacgggtaacgggtacccgtttaagggtaaacccttttaaacggttttaacccggttaccggtttaaccggaaacccggttcccgggggtacgggggtaccgtaaccgggtttacgggtaaccgtttaggtttttacggggttacggggtttaccggtttaccggggggaccggggtaaacggggggtaaacccgggtaacggttacccggttacccggggttaaaccccgggttccggggtttaacccgggaccgggtaaccccgggaaccccggttacgggtaccccggttcccccgggttaaccccccccggttcccgggg

SEQ ID NO: 144173 - DNA, 709 bp, Homo sapiens
  misc_feature: GYAE6OF01A7CSL.12.57.F02.1.454.CMB.1.raw
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctcgtgggacgcctcggtcaagcctcacctgcactctagacgtcaggtggcactactacctcgccatccgctggcatacaacaacacgcaggacggacgggcctacgatacgttgatcgtatttagtaacagtagagtcggacacgaccaacgaacgggaacgggggacgacgtaccgtagacgtcgtcttcgtacgacgtctaccgtacggttcggcggggtactacggacgtccgtaccgtaccctaccacctactcccgtaccgaccgtcccctacgcgtacgtacggaacggtagtcggacgttcgtaaacgttacgttacgtttaccgtacgttacgccgggtaaccggttcgggaccctacggttaccggtcgtttagggttaccgggttacggggttaccgggtaccggggtacggggaaacgggtaccgtacggtcccggtaccgggttccccgttaccggggttacggacccgacccgggttacccgggaccggttccccgtaccccggcccccggttaaccgg

SEQ ID NO: 144174 - DNA, 893 bp, Homo sapiens
  misc_feature: GYAE6OF01EZYCU.12.57.F02.1.454.CMB.1.raw
  modified_base (127)..(127): a, c, t, g, unknown or other
  misc_feature (127)..(127): n is a, c, g, or t
  modified_base (157)..(157): a, c, t, g, unknown or other
  misc_feature (157)..(157): n is a, c, g, or t
  modified_base (251)..(251): a, c, t, g, unknown or other
  misc_feature (251)..(251): n is a, c, g, or t
  modified_base (727)..(727): a, c, t, g, unknown or other
  misc_feature (727)..(727): n is a, c, g, or t
tcagatacgacgtacacgaccggtgctcgatttagctcgatatagttgggtttggggagagctctggggagtctgcaccatggcttggaccccactcctcttcctcaccctcctcctccactgcacngggtctctctcctaacttgtggtgacttanaatccgcccttcgtagcccttctcgcccttcgtacggtggggactcccgtacgggtacaacgtccttaccgaacccgtggaccttaccgttcgnggaacgtccgtagggtcgggacctaaccgttaccgttacccgtttcggaccctagtccggtcgtcggacctaacgtaaccaaaccgaaccgacgacccggtaaaggaccggggtacccgggtacccttacggtaaacttttaccgtggtaagtttacggtaagttttacgtaaacggtggttagaacggttcggaacacggaaccgaaacggaacgggggtaaacgggcggttacctccgagtacgtccgtccttacgacgtaacggtcctacgggttcggttacgggtcggtaccgaggtaaccggtccttaaccctttacccggtacaccctttacccgtactcccgtaaccgttcccctacgggtttacgtaggaccggtaaggtattccgggaaagttacttaccggtaactttacggttccgttacgggacgtaaccgggtttccgggcggtaactacgggtttaccggtntttaggttccggggttaaatcccgggggttaaggggaacggggttaccggtaaccgggactttaccggggttacccgggtaccgttaccccggggttaagggacccctacccggggttaaccgtaccccgggttcccccgggttcccctaacccgggggttccccc

SEQ ID NO: 144175 - DNA, 759 bp, Homo sapiens
  misc_feature: GYAE6OF01EWBK6.12.57.F02.1.454.CMB.1.raw
  modified_base (162)..(162): a, c, t, g, unknown or other
  misc_feature (162)..(162): n is a, c, g, or t
  modified_base (393)..(393): a, c, t, g, unknown or other
  misc_feature (393)..(393): n is a, c, g, or t
  modified_base (572)..(572): a, c, t, g, unknown or other
  misc_feature (572)..(572): n is a, c, g, or t
  modified_base (583)..(583): a, c, t, g, unknown or other
  misc_feature (583)..(583): n is a, c, g, or t
  modified_base (633)..(633): a, c, t, g, unknown or other
  misc_feature (633)..(633): n is a, c, g, or t
tcagatacgacgtacacgaccggtgctcgatttagctcgatatagttggggtttgggggagagctctgggggagtctgcaccatgggcttcggaccccactcctcttcctcacccctcctcctccactcgcacgagggtctcctctacccaagttggtggtnactcaactccgtccctcttcgcccttcgtcgtcccttcgtcggtaggggccgtcccggtacgggtacaacggtccctaccgtccgtcgccttacgtccgtagaacggtcgtagggtacggacctacctaccgttacccgtccgactcgtcgccgtagacaactacaacaacgtcgacgaaggacggtaccggtacctacgtactcgtagtacttggttaatacggtaacgnggttacgagtaccgacgtaaccgaacgaaacgggaaggggaccggggtaaccgtaccgtacggtacgtccgtacgttccgtacgacggtaccgtcgtacggttacggtcggtgggacctaggccggtacctacctaccgcctccgtaccttccaaccggctcccgtaagtcggttaacngggtaaacggnggtacgtgtaaccgtatacggtttacgtccgtaacgcgtaccggggtacngggtactacgtgggttacttaggtcgggtaacggtccgggtaggggacggtaacggtctacggacgttccggtcggtacgggccgttacggaccttaccggcgggttacccccgtccgccgtacgg

SEQ ID NO: 144176 - DNA, 538 bp, Homo sapiens
  misc_feature: GYAE6OF02FUW5O.12.57.F02.1.454.CMB.1.raw
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactaccttcgccatcgcctggcatcaacaacagccagagaggggccctcgatacttgatgattgtaacagtgatggcagccacaacgaagggggacggatcccgtgatcgcttctcaggctccagttcgtggggctggagcgctacctcaccatctccagcctccagtctgaggatgaggctgacttattactgtcagaccgtggggctacgtggctagttggtggttacgttcgggacgggagggacggaaggccgtacggacccggttccgtggggtccacggccccgaagggccctccggccccccgtcggg

SEQ ID NO: 144177 - DNA, 576 bp, Homo sapiens
  misc_feature: GYAE6OF02I0RT5.12.57.F02.1.454.CMB.1.raw
  modified_base (357)..(357): a, c, t, g, unknown or other
  misc_feature (357)..(357): n is a, c, g, or t
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactaccttcgccatcgcctggcatcaacaacagccagagaggggccctgatacttgatgattgttaacagtgatggcagccaacgaacgaagggggacggatccctgatccgcttctcgaggctccgagttcgnggggctggagcgctacctcaccatcctccagccctcgagtctgacggatgaggctgacttattactgtcacgaccgtggggacctacgtcggactagttcggtagggttacttccgggacgggtaagggaccgtaaggtccgttacgggaacccgttccggtaggggttacccacgggtacccccgtaaagggtcccttaccggcccccccgttacggg

SEQ ID NO: 144178 - DNA, 709 bp, Homo sapiens
  misc_feature: GYAE6OF02GSNEG.12.57.F02.1.454.CMB.1.raw
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcaggtgggcacactaccttcgccatcgcctggcatcaacaacagccagaggacggggccctcgatacttgatgattgttaacagtgagtggcagccaacaaacggaagggggacgggtactcccgtgactcgtcttctcgacggtcctccgtaggttccgtgggggtctggacggccgtcctacccgtaccacccgtacttcccgtacccgacgtcccctaccgtacggttccgtagggaacgggaagtcgggaacgggtccttacgtaaccttaacgtttaccgttggtaccgaacggtacccggttgggggaccctacgggtcggtacttaaggtttggttacggggttacgttccgggggaccggggtaacggggtaccggtaaacgggtccggttaccgggtaaccccggtttccgggttacggggttaccgaacccgggtaccccggtaaaccgggtcccggttaccccgggtcccccccggttaccgggg

SEQ ID NO: 144179 - DNA, 728 bp, Homo sapiens
  misc_feature: GYAE6OF02ICIDL.12.57.F02.1.454.CMB.1.raw
  modified_base (166)..(166): a, c, t, g, unknown or other
  misc_feature (166)..(166): n is a, c, g, or t
  modified_base (281)..(281): a, c, t, g, unknown or other
  misc_feature (281)..(281): n is a, c, g, or t
  modified_base (339)..(339): a, c, t, g, unknown or other
  misc_feature (339)..(339): n is a, c, g, or t
tcagatacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatccgccctntgcctctgccctctcgtgggacgccctcggtcaagctcacctgcactctagacgcagggtcggaccactaccgttaccttccgcctagtccgccgtggaccactaccaaacaacncgaccgaggaggaccggggcccctagacttaacgttgattaggactttacgttaaacnggttacgagtcggacaacgacaaaaccgaaacgggtaacgggggacgtactcccgtgtacgtccgtcttcgtacgacggtcctcgtacggttcggcggggtctggacgccgtacctacccgtacaactcgttaccgccacgtccctaaccgtggtaccgtggacgggtacacgggtacgtcggttactaaccgtttcgttaaccgtcggtacgaccgggttacggtcgggaccgtacgtcggtacgtttcgttagggttacgttaccggggtcgggtacggggtaacgggtacgtaccgggtaccgttcgggttaccccggtacggttcggggaacctacccgggtaaccccggtagggttccccctacccgggtccccgtttaaccgg

SEQ ID NO: 144180 - DNA, 674 bp, Homo sapiens
  misc_feature: GYAE6OF02GY651.12.57.F02.1.454.CMB.1.raw
  modified_base (389)..(389): a, c, t, g, unknown or other
  misc_feature (389)..(389): n is a, c, g, or t
  modified_base (620)..(620): a, c, t, g, unknown or other
  misc_feature (620)..(620): n is a, c, g, or t
tcagatacgacgtacacgaccggtgctcgatttagctcgatatagttgggtttggggaatgactctagaagtctcccacatctgacctttctgggtggaggcagctggtggccctgggaatataagaatctccaggatgatgactctgtgtatttggtgggactaaactttatacggaaacccggaaaggacagtggccagtggggtgggtaggacagtagggacagagtcgccagccgtggaggtggacgcctgacggacacgagggtggacaacgaaacactacaccaacaataaggcggacggatacggacccgagtccgtaccccacacgcacgacctgagacgcgacgtcggacccacaccgtcccctacccgtagacggaccncccgtagcctcgacccttcccgtaccggtccaccgtcccgtacggacctaccgttccccgtaccggtttcccgacggtccgttacggggtacggtttaaggttacgaagttcggtacggttctgtcgtactacggttgttaagttacgttacgttagtttagtttccgtacgtttaggtttaacttaaccacgtagtagttcgtacagtacgcttacactaaccaaccgtntacggacctagacctcccgtaccacgtacccaccttcccgaccgtaggtcccgg

SEQ ID NO: 144181 - DNA, 869 bp, Homo sapiens
  misc_feature: GYAE6OF02F2XDT.12.57.F02.1.454.CMB.1.raw
  modified_base (187)..(187): a, c, t, g, unknown or other
  misc_feature (187)..(187): n is a, c, g, or t
tcagatacgacgtacacgaccggtgctcgatttagctcgatatagttgggtttgggggagagctctggggagtctgcaccatgggcttggaccccactcctcttcctcaccctcctcctccactgcacagggtctctctcccaacttgtggtgactcaatcgccctctgcctctgcctctctgggancctcggtcaagctcacctgcactctgagcaggtggcacactacctcgccatcgcctggcatcaacaacagccagacggacggggcccctacggataccgttgattggtaatttcggttaacagttacgatcgggtacacgacccgaacgaaaccggaaggggggaccggtaacttccccgtaggtactcccggtcctttccggtaccgtaaccgggtcctttacccgaagggttttcccggtcggggggtaccttacggggaaccgtcccggtacccgtttaacccgtcctaaacccgtagtttcccccgtaccgaaccggttacccccttaccgtagggtttcctaacggggtaacgggtaaccttaccggggtaacggacccgtttacgggtaaaccctttaaccgtttaaccggttccgggtttaaccgaacccgggtaaccgggtttccgggggacccttaaacccgggtttcgggtacccgttaaggttttcgggggttaaggttacccggggttttaccgggggacgggtaacggggtaacccgggttaacggtaccgggtttaaccgggtaaccccccgggtttacgtaacccgggggtttacccaacccgggggtaaccccccggtaagggtttacccccggtttccccggtaccccccccggtttaacggggg

SEQ ID NO: 144182 - DNA, 720 bp, Homo sapiens
  misc_feature: GYAE6OF02GZDJL.12.57.F02.1.454.CMB.1.raw
tcagatacgacgtacacgaccggtgctcgatttagctcgatatagttgggtttggggagagctctggggagtctgcaccatggcttggaccccactcctcttcctcaccctcctcctccactgcacagggtctctctacccaacttgtggtgactcaatccgccctctcgcctctcgcctctccgtgggacgccgtcggtacaagctccacctgcactctgagcgaggtcggacacaccgttacctcgaccacgtccgccgtggacactaccaaaccaaccgacgaccgaaggtacgggaccgggtccctacgtaacttacgttagagttagtagtttacgtaacgtagtagagtcggcacgaccgacgaacgggaaggggacgtacaccgtgacgtcgtacttcgacgacgtactacgtacgttacggtcgggtctaggacgtaccgtacctaccgtaccaccgtacttacctaccgaccgttccctaccgtacgttcggaggtaacgtacgtgggaacgttcctaacgttacgttacgttaacgcgtacgtaacggcgggttacgggactacggtcgttacgttagttacggttaggttaccgggcggggtaggaaccggggtaacgtcggttaccggtacggttaccccggtagggttaccgacccggtacccggtaacggtacccggtacccggttcccccggtacccgttcccgg

SEQ ID NO: 144183 - DNA, 490 bp, Homo sapiens
  misc_feature: GYAE6OF01BBJ9N.53.27.C05.1.454.CMB.1.raw
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagcgcgtatacacacgaccggtgctcgatttagacgcgatcgaagggtttggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaatggtatcagcagaaaccaggacaagcccctaatattctgatcttggctgcaaacactttgcaaagtgggtcccatcaaggttcagtggcagtggatctgggacagaattcactctcacgatcaacagtctgcaggctgacgattttgctaacctactactgtcaacagagttacagtttccctcggacgttcggccgaacggaccgacggtggagatcgaagcgaacgtgtggctgcncntcg

SEQ ID NO: 144184 - DNA, 485 bp, Homo sapiens
  misc_feature: GYAE6OF01DVRQN.53.27.C05.1.454.CMB.1.raw
  modified_base (478)..(478): a, c, t, g, unknown or other
  misc_feature (478)..(478): n is a, c, g, or t
tcagcgcgtatacacacgaccggtgctcgatttagacgcgatcgaagggtttggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccggcaagtcagatcattgatcattaaatgtatcagcagaaaccaggacaagcccctaatattctgatcttggctgcaaacactttgcaaagtgggtccatcaaggttcagtggcagtggatctgggacagaattcactctcacgatcaaacagtctgcaggctgacgattttgcaactactactgtcaacagagttacagtttcccctggacgttcggcctaaagggccaacggtggtacgatcaagcgaactgtggactgcnccgatcg

SEQ ID NO: 144185 - DNA, 484 bp, Homo sapiens
  misc_feature: GYAE6OF01DDKWG.53.27.C05.1.454.CMB.1.raw
  modified_base (431)..(431): a, c, t, g, unknown or other
  misc_feature (431)..(431): n is a, c, g, or t
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
tcagcgcgtatacacacgaccggtgctcgatttagacgcgatcgaagggtttggggagtcagtctcagtcaggacacagcatggacatgagggtccccgctcagctcctgggctcctgctactctggctccgagatgccaattgtgacatccagatgacccagtctccatcctccctgtcagcatctgtaggagacagagtcaccatcacttgccgggcaagtcagatcattggaatccatttaaattgtatcagcagaaacaggacaagcccctaatattctgatcttggctgacaaacactttgcaaagtgggtcccatcaaggttcagtggcagtggatcgtggacagaattcactctcacgatcaacagtctgcaggctgacgtattttgctaacctactactgtacaacagagttacagtttcccncggtacgttcggccaagggaccaggtggagancaagcgaatgtgctgcncntc

SEQ ID NO: 144186 - DNA, 489 bp, Homo sapiens
  misc_feature: GYAE6OF01CBJ0W.53.27.C05.1.454.CMB.1.raw
  modified_base (486)..(486): a, c, t, g, unknown or other
  misc_feature (486)..(486): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtgggtcccatcaagttcagtggcagtgatctgggacagaattcactctcacgatcaacagtctgcaggctgacgattttgctaacctactactgtcaacagagtttacagtttccctcggtacgttcggcctaagggaccacgggtggagatacagcgaactgtgctgcacntcg

SEQ ID NO: 144187 - DNA, 548 bp, Homo sapiens
  misc_feature: GYAE6OF01AO2PQ.53.27.C05.1.454.CMB.1.raw
  modified_base (469)..(469): a, c, t, g, unknown or other
  misc_feature (469)..(469): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaacgacccctaatattctgatcttggctgacaaactactttagactaaaggtcggggtcccaattcgaaaggttcaaggttggactaggtggatcgtagggacaagtaattcactctacaacgatacaacagtctagcaggctagacgtattttcgactaacctactactgtacaacagtaagttactacgtttcccncggtacgttcggaccgaacggtaccgaggtcggaagagtacgaacgacgaacgttaggtcgcgtagacaccgtattccg

SEQ ID NO: 144188 - DNA, 512 bp, Homo sapiens
  misc_feature: GYAE6OF01BK7ZO.53.27.C05.1.454.CMB.1.raw
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgattttgactaacttattactgccaacagtacaatactttgtggacgttcggccaagggaccaaggtaggaaatacaaacgaacgtgtggctgcaccntctgtcttancttcctcccgtacc

SEQ ID NO: 144189 - DNA, 493 bp, Homo sapiens
  misc_feature: GYAE6OF01DYHEB.53.27.C05.1.454.CMB.1.raw
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgacaaagtggggtcccatcaaggttcagtggcagtggatctgggacagaattcactctcacgatcaacagtctgcaggctgacgattttgctaacctactactgtcaacagagttacagtttccctcggacgttcggccgaagggaccacggtggagatcgaagacgaactgtggctgcncntcg

SEQ ID NO: 144190 - DNA, 735 bp, Homo sapiens
  misc_feature: GYAE6OF01EIYS7.53.27.C05.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatacagatgacccagtctccatcctccctgtcagcatctgtagganacagagtcaccatcacttgccgggnaagtcagatcattggaatcctaattttaaatggtatcagacaagaaaccaggacaacgcccctaatacttctgtatcgttggctagactaaactactttagacgtaaacggttcgggtaccctaagtacgtaaacggtttcgaacggttacgggacgtaagggtacggtaacgtttacggtacggggtaaacctaaaggttaaaccgttttaccgaacctttaccgttaacgtaaccggtaacttacccgaaaccgtacggttaccgttacggaccgtaagggtccttaggtaaccgtttacgttttacggaaccttaaaccctttaacttaccgttacgtaaccgtaaacgtaacggttaacgttacccgttaccggttttccccgtacgggtacccgttaccgggtaacccgtaaacggggtacccgtacgggtacgggtaacgtacgttaacggaaacgtacgggtaaccgttagggtcggtaccgtagaccctaaccgacgtttacccgg

SEQ ID NO: 144191 - DNA, 513 bp, Homo sapiens
  misc_feature: GYAE6OF01E1Y4Y.53.27.C05.1.454.CMB.1.raw
  modified_base (509)..(509): a, c, t, g, unknown or other
  misc_feature (509)..(509): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtggggtcccatcaaggttcagtggcagtggatcgtgggacagaattcactctcacgatcaacagtctgcaggctgacgtattttcgctaacctactactgtacaacagtacgttactacgtttccctacgggtacgttcggccgtaacgggacccgacggtacggagagtcaagacgaacgtgtcggactgcacngtcg

SEQ ID NO: 144192 - DNA, 550 bp, Homo sapiens
  misc_feature: GYAE6OF01BF3V3.53.27.C05.1.454.CMB.1.raw
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (334)..(334): a, c, t, g, unknown or other
  misc_feature (334)..(334): n is a, c, g, or t
  modified_base (377)..(377): a, c, t, g, unknown or other
  misc_feature (377)..(377): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttgccggcaagtcagatcattgaatccatttaatgtatcagnagaacagacaagccctaatatcngatcttaggctgcaaactactttgacaaaggtcgggtcccatcgaaggttcagtgnaggtgatcgtggacagaattcactctcacgatacaactagtcngcacgggtctagtaacgtattttcgacctaaccttaactaccttagtaccaactagtacgtttaaccgacgtttaccctacggtacgttaccggaccgtaacgggtacccgacggtacggacgtaagtacgaacggaccgtaacgtagtcggtactacgactaccgattaccg

SEQ ID NO: 144193 - DNA, 510 bp, Homo sapiens
  misc_feature: GYAE6OF01ERIQN.53.27.C05.1.454.CMB.1.raw
  modified_base (256)..(256): a, c, t, g, unknown or other
  misc_feature (256)..(256): n is a, c, g, or t
  modified_base (346)..(346): a, c, t, g, unknown or other
  misc_feature (346)..(346): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatnagcagaaaccaggacaagcccctaatattctgatcttggctgcaaacactttgcaaagtgggtccatcaaggttcagtgcagtggatcgngggacagaattcactctacacgatcaacagtctgcaggctgacgtatttgccaaccttactactgtacaacagtagttacacgtttcccgtcggtacgttcggaccgtaacgggacctaagttgggtaggagagtccaagcgaactggtggactgccactaacg

SEQ ID NO: 144194 - DNA, 615 bp, Homo sapiens
  misc_feature: GYAE6OF01BA51Z.53.27.C05.1.454.CMB.1.raw
  modified_base (253)..(253): a, c, t, g, unknown or other
  misc_feature (253)..(253): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccggcaagtcagatcattgaatccatttaatgtatcancagaaccaggacaacgacccctaatattctgatcttggctagacaaaactacttttagacgtaaaaggttcggggtaccctaatacgtaaaggttcaaggttggacgtaaggtggatcgtagggacaaggtaattcaactctacaacgtactacaaactagtctaggcgaacggtcttacggtaacgttatttttacgaccgtaaacccttacgtaacctcgtaacaaacgtacgtaacgtttaacctacggtttaccccgtacgggtaccgttaccggaccgaacgggtaccgtacgggtaggtacgtaagtacgaacggacggtaacgttcggtacggcgtacgccgtacgtcgttaccg

SEQ ID NO: 144195 - DNA, 579 bp, Homo sapiens
  misc_feature: GYAE6OF01BDV5P.53.27.C05.1.454.CMB.1.raw
  modified_base (196)..(196): a, c, t, g, unknown or other
  misc_feature (196)..(196): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtagganacagagtcacatcacttgccgggcaagtcagatcattggaatctaatttaaatggtatcagcaagaaaccaggaacaacgacccctaatacttctagtacttcgttggctagactaaactacgttttagactaaagggtcgggtacctaagtaccgtaaggttcaggtggacaggtggatcgtaggactagtaacttcaactctacacgtactacaactagtctagacgacggtctaggtacgttattttacgacctaaccttactaccgttagtacaacgtagtacgttacgtacgtttcccgtacggtacgtcggaccgtaacggtaccgtacggtaggacgtagacgaacgacgtaacgtggtacgctagctacgtgtcg

SEQ ID NO: 144196 - DNA, 517 bp, Homo sapiens
  misc_feature: GYAE6OF01A6AUY.53.27.C05.1.454.CMB.1.raw
  modified_base (513)..(513): a, c, t, g, unknown or other
  misc_feature (513)..(513): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttagacaaagtgggtcccatcaaggttcagtggcagtggatcgtgggacagtaattcactctcacgatacaactagtctgcaggctgacgtattttgactaacctactactgtacaacagtagttactacgtttcccgtacggtacgttcggaccgaacgggaccgacgggtcggacgatacgaacgacgaactgtcgctagctcgnttcg

SEQ ID NO: 144197 - DNA, 533 bp, Homo sapiens
  misc_feature: GYAE6OF01DPSAK.53.27.C05.1.454.CMB.1.raw
  modified_base (255)..(255): a, c, t, g, unknown or other
  misc_feature (255)..(255): n is a, c, g, or t
  modified_base (388)..(388): a, c, t, g, unknown or other
  misc_feature (388)..(388): n is a, c, g, or t
  modified_base (529)..(529): a, c, t, g, unknown or other
  misc_feature (529)..(529): n is a, c, g, or t
tcagcgcgtatacacacgaccggtgctcgatttagacgcgatcgaagggtttgggggagtcagtctcagtcaggacacagcatggacatgagggtccccgctcagctcctgggctcctgctactctggctccgagatgccaattgtgacatccagatgacccagtctccatcctccctgtcagcatctgtaggagacagagtcaccatcacttgccgggcaagtcagatcattggaatccatttaattgtatcancagaaccaggacaagcccctaatattctgtatcttggctgacaaactactttgacaaaggtcgggtccatcaaggttcaggtgcgagtggatcgtgggacagtattcactctacacgatacaacgtgtctgcngctagacgtatttcgactaacctactactcgtacaactagtacgttacgtacgttttccctaggtacgttccggaccgtaacgggacccgtagggtcggtaacgatacgaagccgtaacgtgtcggacttggaccaccgtntccg

SEQ ID NO: 144198 - DNA, 552 bp, Homo sapiens
  misc_feature: GYAE6OF01DVRR6.53.27.C05.1.454.CMB.1.raw
  modified_base (418)..(418): a, c, t, g, unknown or other
  misc_feature (418)..(418): n is a, c, g, or t
tcagcgcgtatacacacgaccggtgctcgatttagacgcgatcgaagggtttgggggagtcagtctcagtcaggacacagcatggacatgagggtccccgctcagctcctggggcctcctgctactctggctccgagatgccaattgtgacatccagatgacccagtctccatcctccctgtcagcatctgtaggagacagagtcaccatcacttgccggcaagtcagatcattgatctatttaatgtatcagacagaaccaggacaacgaccctaatattctgtattcgttggctgacaaactactttgacgtaaaggtcgggtacccagtacgtaaggttcaggtggcgtaggtggatcgtagggacaagtaattcactctacacgatcaactgtctgcgacggtctaggtacgtnttttcgacctaaccttactactgtaacaatagtacgttactacgtttcccgacggtaccgttcgaccggtaacggaccggaggtaggtacgagtacgaacgacgtacgacggtcggacgtacgcaccgtgtacg

SEQ ID NO: 144199 - DNA, 614 bp, Homo sapiens
  misc_feature: GYAE6OF01CM60N.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttggccgggcaagtcagatcattggaatacctatttaaattgtatcagcaagaaaccaggaacaacgacccctaatacttctgtatcgttggctagactaaactacgtttagactaaaggtcggggtaccctaagtacgtaaaggttcgaaggtcggacaggtggtatcgtagggaacaagtaacttaccgactactacctaacgaacttaccgaaactagttcgtaggaccgaggtcgtacggtaacgttacttttacgacctaaacccgttaactacgtagttacaactagtaacttacgtacgttcccgtacgtaccgtcgtaccgtacggaccggtaccggaggtacggtagacgtacgacgtacggtacgtcggtacgacgcgtaccgtacgtacg

SEQ ID NO: 144200 - DNA, 591 bp, Homo sapiens
  misc_feature: GYAE6OF01CXGIT.53.27.C05.1.454.CMB.1.raw
  modified_base (219)..(219): a, c, t, g, unknown or other
  misc_feature (219)..(219): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcacatcacttgccggnaagtcagatcattggaatctattaatgtatcagcaagaaaccaggaacaacgaccctaatattctagatcttgctagactaaactactttagacgtaaaaggtcggggtacccaagtaccgtaaaggtttcaaggttggactaggtaggagtacgtagggaacaaggtaattaccactactactacgtactacaacgtagtacgtagacgaggacgtagtacgtattttacgacctaacttactactacgtacaacagtaacgttacctacgtttcccgtacggtacgttaccggaccgtaacgggaccgtaacggtacggacgtaagtacaacggacgaaacgtcggtacgacgtacgcgacgtagtaccg

SEQ ID NO: 144201 - DNA, 527 bp, Homo sapiens
  misc_feature: GYAE6OF01BJG4D.53.27.C05.1.454.CMB.1.raw
  modified_base (522)..(522): a, c, t, g, unknown or other
  misc_feature (522)..(522): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaatggtatcagcagaaaccaggacaagcccctaatattctgatcttggctgcaaacactttgacaaagtgggtccagtcaaggtcagtgcagtgatctgggacagaattcactctacacgatacaactagtctgcaggctgacgtattttcgactaacctactactgtcaacagtacgttactagttttacccgtcggtacgttccggtaccgaacgggtaccgaaccgggtggacgtagtacgaacgacgaacgttaggtacggctaggctaccgngtccg

SEQ ID NO: 144202 - DNA, 534 bp, Homo sapiens
  misc_feature: GYAE6OF01A9FSU.53.27.C05.1.454.CMB.1.raw
  modified_base (522)..(522): a, c, t, g, unknown or other
  misc_feature (522)..(522): n is a, c, g, or t
  modified_base (529)..(529): a, c, t, g, unknown or other
  misc_feature (529)..(529): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatcctaatttaaattggtatcagcaagaaaccaggacaacgacccctaatacttctagattcttggctgacaaactactttgacaaagtcgggtccatcaaggttcagtgcagtgatcgtaggacagattcactctacacgatacaactagtctgcagctagtactagtttgacctaacctactactacgtacaactagtacgttactacgtttcccgtacggtaccgttcggaccgaacggaccgacgggtggacgagtacgacgacgaacgtcgtacgcgtanctaccgngtccg

SEQ ID NO: 144203 - DNA, 635 bp, Homo sapiens
  misc_feature: GYAE6OF01D174P.53.27.C05.1.454.CMB.1.raw
  modified_base (103)..(103): a, c, t, g, unknown or other
  misc_feature (103)..(103): n is a, c, g, or t
tcagcgcgtatacacacgaccggtgctcgatttagacgcgatcgaagggtttgggggagtcagtctcagtcaggtacacagcatggacagtgagggtccccgntcagcttcctgggctcctgacgtacgtctggcctccgagattgcctaattcgtgacatccagatgacccagtctccatccctcccgtgtcagcatctgtaggagacagagtcaccatcacttgccgggcaagtcagatcattggaatcctaatttaaattggtatcagcaagaaccaggaacaacgcccctaatattctgtattcttggctgactaaactacttttgactaaaggtcggggtaccctagtacgtaacggtttcaaggtggactaggttggtaagtttcggggactaaggtaacttcctacttctacaacgtactacaacgtagttactagcgtaggcttacgaacgttattttacgacctaaccgttacttactacgtacaaactaagtacgttaccgtacgtttacccgtcggtaaccggttccggaccggtaaaccgggtaccgtacgggtagacggtaacgtacgaaacggtcggtaaccgtggtacgtcgttacgacctaaccgtagttccgttaccg

SEQ ID NO: 144204 - DNA, 537 bp, Homo sapiens
  misc_feature: GYAE6OF01BD3TL.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaactactttgacaaagtcgggtaccatcgaaggttcagtgcagtggatcgtgggacagaattcactctacacgatacaactagtctgcaggctagacgtattttacgtaacctactactgtacaactagtacgttactacgtttccctacggtaccgttcggaccgaacgggacctacggtaggacgtacgtacgaaggcgtaaacgtggtacggtctacgaccacctgtcgttacg

SEQ ID NO: 144205 - DNA, 505 bp, Homo sapiens
  misc_feature: GYAE6OF01EMU9U.53.27.C05.1.454.CMB.1.raw
  modified_base (222)..(222): a, c, t, g, unknown or other
  misc_feature (222)..(222): n is a, c, g, or t
  modified_base (435)..(435): a, c, t, g, unknown or other
  misc_feature (435)..(435): n is a, c, g, or t
  modified_base (501)..(501): a, c, t, g, unknown or other
  misc_feature (501)..(501): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttgccgggnaagtcagatcattggaatccatttaaatggtatcagcagaaccaggacaagcccctaatattctgatcttggctgcaaacactttgacaaagtgggtcccatcaaggttcagtggcagtggatcgtgggacagaattcactctcacgatcaacagtctgcaggctgacgtatttgcaacctactatgtacaacagtacgttacacgtttcccncggtacgttcggaccgaggaccgtaggtggagtagtacgaagccgaaatcgtaggtacagcctacnttcg

SEQ ID NO: 144206 - DNA, 669 bp, Homo sapiens
  misc_feature: GYAE6OF01CU25M.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctcctgtcagcatctgtaggagacagagtcaccatcacttggccgggacaagtcagatcattggaatctatttaattgtatcagcaagaaaccaggacaacgaccctaatattctgtactcttggctagacaaactctttagacgtaaaggtcgggtacccaagtacgtaaaggttcaggtggacgtaggtggattcgtagggtaacaagtaacttacactcgtacgaacgtactacaaacgtacgtactggacgtaagggtcttacggtaaccgttaagtttttacgaacccttaaacccgttacttaaccgtacgttaacctaaacgtacggttaaaccgtttaaccgtaaccggttttaccccgtacgggttaccggttaccgggtaacccgtaaacggggacccgtaacgggtacgggtaacggtaacgtacgaaacggtaccggtaaaccgttaggtacgggacttacggaccctaaccgtatttacccg

SEQ ID NO: 144207 - DNA, 824 bp, Homo sapiens
  misc_feature: GYAE6OF01AVNHK.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtctccatccctccctgtcagcatctgtaggagacagagtcaccatcacttggccgggacaagtcagatctagttggaatcctaatttaaattggtatcagacaagaaaccgaggaaccaacgtacccctaaattacttctagtattcgttaggcttacgacctaaactactttaggaccgtaaagggttcggggtaccctaagttaccgtaacggtttcgaaggtcggtacgtaaggtggtaacgttacggtaggggtaaactaacgggttaaactttccgtaaccgttaccgtaccgtaaccggtaacttaccgtaaacgtaacgttccgtacggtaccggtacggtacgttacggttaaaccgtttaacgtttttaccgaacccttaaacccgtttaaccgtttaaccgttacggttaacccgttaaaccggttaacggttaaaccggttttaacccgttaacccggtttttaccccggttaccggggttaaccccgggtttaccgggtaaaccccgggtaaaccggggtaaccccggtaaccgggggttaacgggtaaacggttaaccgtaacggtaaaccgggtacccggtaaaccggttacgggttacgggtacccgttaaccgggtacccgtaaaccgttacgtttacccgg

SEQ ID NO: 144208 - DNA, 551 bp, Homo sapiens
  misc_feature: GYAE6OF01CODVV.53.27.C05.1.454.CMB.1.raw
  modified_base (547)..(547): a, c, t, g, unknown or other
  misc_feature (547)..(547): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaacgcccctaatattctgatcttggctgacaaactactttgactaaaggtcgggtaccctatacgtaaggttcagtggcgtaggtggatcgtagggacagtaacttcactctacacgtactacaactagtctagcgtaggctagtacgtatttacgacctaaacctactactagtactaacgagtacgttactacgtttcccgtacggtacgttaccggaccgaacgggaccgacggtaggacgtatacgaagcgtaactggtcgactgccacgtnttcg

SEQ ID NO: 144209 - DNA, 779 bp, Homo sapiens
  misc_feature: GYAE6OF01DZNLM.53.27.C05.1.454.CMB.1.raw
  modified_base (102)..(102): a, c, t, g, unknown or other
  misc_feature (102)..(102): n is a, c, g, or t
  modified_base (231)..(231): a, c, t, g, unknown or other
  misc_feature (231)..(231): n is a, c, g, or t
tcagcgcgtatacacacgaccggtgctcgatttagacgcgatcgaaggggtttgggggagtcagtctcagtcaggacacagcatggacatgagggtccccgntcagctcctggggctcctgctactctggctcgagatgccaattgtgacatccagatgacccagtcctccatccctccctgtcagcatcgtggtaggagacagacgtcaaccatcacgttcggccggganaagtcagatcagttggaattacctaattttaaattggtatcagacaagaaaccgaggacaacgacccctaatacttctagacttcgttggctagtacaaactactttacggaacgtaaacgggttcgggtaccctaagtaccgtaaggtttacgaaggtcggacgtaggtcggtagttacggtagggaactaagtaacttccgtacttaccgtaccgaaacggtacttaaccgaaacgttacgttaccgtacggtaccgtaacgggtccggtaacggtaacccggtttaatttttacccgggaaccttaaaccccgtttaacgttaacccgttaacgtaaaccgtaaaaccggttaaggtttaaccggtttaaacccggtttacccggttttacccccgggttaaccgggttacccgggtttaccccgggtaaacccgggaaaccggggtaacccgggtaaccgggtaacggggtaacgtaaggtaaccgtaaacgggtaccggtaaagttcgggtacggtcggaaccgtaccctacgtgttacccgg

SEQ ID NO: 144210 - DNA, 599 bp, Homo sapiens
  misc_feature: GYAE6OF01CT8QL.53.27.C05.1.454.CMB.1.raw
  modified_base (196)..(196): a, c, t, g, unknown or other
  misc_feature (196)..(196): n is a, c, g, or t
  modified_base (418)..(418): a, c, t, g, unknown or other
  misc_feature (418)..(418): n is a, c, g, or t
tcagcgcgtatacacacgaccggtgctcgatttagacgcgatcgaagggtttgggggagtcagtctcagtcaggacacagcatggacatgagggtccccgctcagctcctgggctcctgctactctggctccgagatgccaattgtgacatccagatgacccagtctccatccctccctgtcagcatctgtagganacagagtcaccatcacttgccgggcaagtcagatcattgaatcctaatttaaattggtatcagcaagaaaccaggacaacgcccctaatattctgtatcgttggctgactaaactactttgacgtaaaggtcgggtacccagtacgtaaggtttcaggtggctaggtggatcgtagggacagtaacttcacttctacacgactacaactacgttcgtgacgnggtctagtaacgttagttttacgaccttaaaccttacttaaccgtacgtaacctaacgtacgtaacgtttacctacgttttcccgtaccgggtacgttccggaaccgtaaccgggaccgtacgggtacggaacgtactacgaacgacgtaacgtgtacggtactgacccaccgtagttccg

SEQ ID NO: 144211 - DNA, 625 bp, Homo sapiens
  misc_feature: GYAE6OF01DJX2D.53.27.C05.1.454.CMB.1.raw
  modified_base (236)..(236): a, c, t, g, unknown or other
  misc_feature (236)..(236): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtctccatccctccctgtcagcatctggtaggagacagagtccaccatcacgttcggccggacaagtcagntcattgatctaatttaattggtatcagacaagaacaggaacaacgtaccctaatattctagacttcgttggactgacctaaactacgtttagacgtaaacggtcgggtaccaagttacgtaaaggtttcgaaggtcgagtggtagagttcgtagggactaaggtacttcgtacctcgtacaacgtactaacgaacgtagttacgtacgacgtaggtacttaggtaccgtttaacgtttacgacccttaaaccgttacttactacggtactaacgtagtaccgttacgtaccgtttccgttaccggtacggtccggaccggtaagggaccgtagggtacggagtacgtaacgacggtacgtagttcggtcggactacgccacgtgtaccg

SEQ ID NO: 144212 - DNA, 539 bp, Homo sapiens
  misc_feature: GYAE6OF01D83Y3.53.27.C05.1.454.CMB.1.raw
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaatggtatcagcagaaaccaggacaagcccctaatattctgatcttggctgacaaaactactttgacgtaaaggtcgggtcccatcaaaggttcaggtggcagtggatcgtgggacagtaattacgactctacacgatacaacagtctagcaggctggaacgtattttcgacctaaccttactacgttgtacaactagtacgttactacgtttacccgtggtaccgttcggaccgtaacgggaccgacggtggagtatcgaacgacgtaacgtgtcggactgacncgngtccg

SEQ ID NO: 144213 - DNA, 557 bp, Homo sapiens
  misc_feature: GYAE6OF01EDEHR.53.27.C05.1.454.CMB.1.raw
  modified_base (196)..(196): a, c, t, g, unknown or other
  misc_feature (196)..(196): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtagganacagagtcaccatcacttgccggcaagtcagatcattggaatcctatttaaattggtatcagcagaaaccaggacaagcccctaatattctgatcttggctagcaaactactttgacaaaggtcgggtcccatacgaaggttcaggtgcaggtgatcgnggganagtatcactctcacgtatacgaaactgtctagacacggctagtacgtattttgacctaaccttactactcgtactaacgtagtacgttactacgtttcccgtcggtaccgttaccggaccgaacggggacctacgggtacggaacgtagtacaacggaccgtaactcgggtcggactagaccacccgtagttacccg

SEQ ID NO: 144214 - DNA, 692 bp, Homo sapiens
  misc_feature: GYAE6OF01D7ATI.53.27.C05.1.454.CMB.1.raw
  modified_base (101)..(101): a, c, t, g, unknown or other
  misc_feature (101)..(101): n is a, c, g, or t
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
tcagcgcgtatacacacgaccggtgctcgatttagacgcgatcgaagggtttgggggagtcagtctcagtcaggacacagcatggacatgagggtccccgntcagctcctggggctcctgctactctggctccgagatgccaattgtgacatccagatcgacccagtccaccatccctccctgtcagcatctgtagganacagacgtcaccatccacgttcggccgganaagtcagactcgtagttaggaacttacctaattttaaagttggtaatacgagtacaacgaaaaccgtacggaaccaacgtaccccttaaattactttacgtacgtaacgttccgttacggacgtacgtaactaaaaccttacgtttacggaacgtaaacgggttccgggtacctagttacgtaaggttcgaggtacggacgtaggtggtagtacggtaggaacgtaagtacttactacgttacctacgtaacgtactacgaaactcgtacgtacgacgacggtctacgtacgttacgtttacgacctaacttactacgtagtaaccgtaacgtagttacgttaccgttacgttcccgtacggtaccgttaccggaccggtaacggtaccggtagggtacggaacgtaacgtacgtaacggtacgtaacgtcggtcggtacgtaccgaccgtacgtcgttaccg

SEQ ID NO: 144215 - DNA, 594 bp, Homo sapiens
  misc_feature: GYAE6OF01CGADI.53.27.C05.1.454.CMB.1.raw
  modified_base (235)..(235): a, c, t, g, unknown or other
  misc_feature (235)..(235): n is a, c, g, or t
  modified_base (404)..(404): a, c, t, g, unknown or other
  misc_feature (404)..(404): n is a, c, g, or t
  modified_base (589)..(589): a, c, t, g, unknown or other
  misc_feature (589)..(589): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctggtaggagacagacgtccaccatcacgttcgaccgggcaagtcagntcattaggaactcctaatttaaattggtatcagacaagaaaccgaggaaccaacgtaccccttaaagttacttcctaggtacttcgttcggtctacgaactaaactgtttacgacgtaaaggtcgggtaccagtaccgtaagtcaggtggctaggtgactgtacggganagtacttcactctaccgacgtactacgaatacgtctagacgagcgtagacgttatttcgaactacctactactgtaacctaagtagtagtttaccgtacgtttcccgtaggtaccggttaccggaccggtaacgggaccgtagggagtacgactacgagaccgtaagcgtacggactgacctagnttacg

SEQ ID NO: 144216 - DNA, 516 bp, Homo sapiens
  misc_feature: GYAE6OF01A092C.53.27.C05.1.454.CMB.1.raw
  modified_base (510)..(510): a, c, t, g, unknown or other
  misc_feature (510)..(510): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaatggtatcagcagaaaccaggacaagcccctaatattctgatcttggctgacaaacactttgacaaagtgggtcccatcaaggttcagtggcagtgatcgtggacagaattcactctcacgatacaacagtctgcaggctagacgtattttcgacctaacctactactgtacaacagtaacgttactacgtttcccgtacggtacgttcggaccgaacgggaccgacggtggagagtacaagacgaacgtgtcggactgcacngtaccg

SEQ ID NO: 144217 - DNA, 511 bp, Homo sapiens
  misc_feature: GYAE6OF01CEEC7.53.27.C05.1.454.CMB.1.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (501)..(501): a, c, t, g, unknown or other
  misc_feature (501)..(501): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtcaccatcctccctgtcagcatctgtaggagacagagtcaccatcacttgccgggcaagtcagatcattggaatccatttaaattggtatcagcagaaaccaggacaagcccctaatattctgatcttgctgacaaactactttgcaaagtcgggtccatcaagttcagtggcagtgatcgtggacagattcactctcacgatcaacngtctgcaggctgacgtntttcgactaacctactactcgtacaacagtaacgttactacgtttccctacggtaccgttcggaccgagggaccgacgggtgagatacgaagcgtaacgtggtcggctgcnccgtgttccg

SEQ ID NO: 144218 - DNA, 645 bp, Homo sapiens
  misc_feature: GYAE6OF01DTIDP.53.27.C05.1.454.CMB.1.raw
  modified_base (101)..(101): a, c, t, g, unknown or other
  misc_feature (101)..(101): n is a, c, g, or t
tcagcgcgtatacacacgaccggtgctcgatttagacgcgatcgaagggtttgggggagtcagtctcagtcaggacacagcatggacatgagggtccccgntcagctcctggggctcctgctactctggctccgagatgccaattgtgacatccagatgacccagtctccatcctcctgtcagcatctggtaggacacagagtccacatcacgttggccgggcaaaggtcagtactcaagttcggaactcctaatttaaacttggtatcagtacaagaaccaggacaacgtaccctaatacttctgtattcgttaggactagactaaactacgtttacgacgtaaaggttcgggtacctaagtacgtaaacggttcaggtcggacgtaggtggtaacttcggtacgggaactaacgtaacttccgacttactaccgaacgtactaacgaaacgtagttccgtacggactaacgggcttaggtacgttacgttttacgaacttaaccgtacttactcgtaactaacgtacgtaacgttactaccgtttaccgcgggttacgtccggtaaccgtacgggaccgtacggtaggtacgtagacgtaaacgcggtaacgttggtacgcgttacggacctacgtgttaccg

SEQ ID NO: 144219 - DNA, 733 bp, Homo sapiens
  misc_feature: GYAE6OF01AD4YJ.53.27.C05.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtcaccatccctccctgtcagcatctgtagganacagacgtcaccatcacgttggccgganaagtcagactctagttacggtaactacctaattttaaagttggtactaccgaagaccaaacgaaacccgacggtaacaaccgtaccccttaattacttctagtatttccgttaggtcctacgtaacctaaaccgttacgtttacggaaccgtaaacgggtccggggtaccctaacgttacgtaagggttcgagggttcggacgtagggttaggtacgttacggtacgggtaactaagtaaccttacctaccgttacgtaccgaacgttaacgtaccaaacggtacggttcgtacggaccgtacggtcgtaacggttaacgtttacgtttaccgaacccttaaccgttactacgtacgtaacctaacgtacgttaaccgtttaccgttaccggtttacccgacgggtaccggttaccggacccggtaacgggacgtacgggtaacggtacgtacgacggtacgtaccggtacgttacgggtcggactaccgacctaccgtgttacccg

SEQ ID NO: 144220 - DNA, 666 bp, Homo sapiens
  misc_feature: GYAE6OF01CQFK9.53.27.C05.1.454.CMB.1.raw
  modified_base (227)..(227): a, c, t, g, unknown or other
  misc_feature (227)..(227): n is a, c, g, or t
  modified_base (465)..(465): a, c, t, g, unknown or other
  misc_feature (465)..(465): n is a, c, g, or t
tcagcgcgtatacacacgaccggtgctcgatttagacgcgatcgaagggtttgggggagtcagtctcagtcaggacacagcatggacatgagggtccccgctcagctccgtggggctcctgctactctggctcgagatgccaattgtgacatccaagatcgaccctagtcctccactccctccctgtcagcatctagtagagacagagtcacatcgactggccgganagtcagatctattaggaatacctaatttaaattgtaatcagacaagaacaggaacaacgtaccctaattacttactagactcgtagtctagactaaactacgttagacgtaaaacggtcgggtaccctaagtaccgtaaaggtttacgaaggtacgagtaaggtgggtaacttacggagggtaacaacggtaacttacacctacgtacaagtactaacaacgtagtccagtacgacgngttacgaacttagtttacacttaaccgtataacgtctaacaacgtacgttaacgttaccgttaacgtttcccgtaccgggtaaccgttccgggaaccggaacgggtaacccgtacgggtaacgggtaacgtaacggtacgaaacgggtacgtaaaccggttacggtacggtacgtacgaacccgtaaccgtgtttaacccg

SEQ ID NO: 144221 - DNA, 691 bp, Homo sapiens
  misc_feature: GYAE6OF01DJT8Y.53.27.C05.1.454.CMB.1.raw
  modified_base (226)..(226): a, c, t, g, unknown or other
  misc_feature (226)..(226): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtcctccatccctccctgtcagcatctgtaggagacagagtcaccatcacttggcccggganaaggtcagatcattggaatcctaatttaagttgtatcagacaagaacaggaacaacgacccctaatacttctgtacttcgtggctagactaaactacgtttagacgtaaggtcgggtacctaacgtacgtaaggttcgacgtgggctagggtggtacgtcgtagggtaactagtaacttcctaactcctacgaacgtactaccgaactacggttctacggacgaggaccgttacgtaacggttacgttttacggaaccctaaacccgtttaactacgttaccgtaaccgtaaacgttacggttaacgttaccgttaaccgttttccccggtaccgggtaccggttacccggtaaccgggtaaacccgggtaacccgaacggggtacggaacggtacgtaaccggaaacggtaccgtaaaccggttcggtaccggtacgtacccgcccgtaaccttcggttacccg

SEQ ID NO: 144222 - DNA, 650 bp, Homo sapiens
  misc_feature: GYAE6OF01A2T22.53.27.C05.1.454.CMB.1.raw
  modified_base (101)..(101): a, c, t, g, unknown or other
  misc_feature (101)..(101): n is a, c, g, or t
  modified_base (411)..(411): a, c, t, g, unknown or other
  misc_feature (411)..(411): n is a, c, g, or t
  modified_base (439)..(439): a, c, t, g, unknown or other
  misc_feature (439)..(439): n is a, c, g, or t
  modified_base (472)..(472): a, c, t, g, unknown or other
  misc_feature (472)..(472): n is a, c, g, or t
tcagcgcgtatacacacgaccggtgctcgatttagacgcgatcgaagggtttgggggagtcagtctcagtcaggacacagcatggacatgagggtccccgntcagctccgtggggctcctgctactctggctccgagatcgccaattgtgacatccagatgacccagtctccatcctcctgtcagcatctggagagacagactcaccatcacgttgccggacaagtcagtactctatggaactaccttaatttaaagttggtaactcaacgagaaacgaaacccgtaggaaccaacgtaacccccttaaagttaagttcgtaccgtaatttaccggttcggtaccttaggaacctaaactacgtttacgaaccggtaaagtccgggtacctaagtacgaaggttcagtcgnagtagtacgtcgtaggacagtacttacncttcgacacgtactacaactcgttctacgaagnggtaccgttagtaccgttagtttaccaaccgtaccttaactacgttacgtactaacgtacgtacgttacttacggttccccgtagtaccggtagtacccggaaggttacccgaaggtagtaccggtacacgtaaacggaccgtaacgtacggttccggataccggactattaccggtc

SEQ ID NO: 144223 - DNA, 579 bp, Homo sapiens
  misc_feature: GYAE6OF01EHVHS.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttggccggcaagtcagatcattggaatccaattttaaattggtatcagcagaaaccaggacaacgcccctaatattctgattcgttggctagacaaactactttgactaaaggtcgggtacctagtacgtaaggttcaggttcggcgagttggatcgtagggacaagtaattcactctacacgatacaacagtctagcaggcgtgtacgtattttcgacctaaccttacttaacttgtaccaactacggtacgttacgtacgttttccctaccgggtaccgttcggaccgaacgggaccgtacgggtacgggaacgtatacgaacggaccggtaaacgtcggtacggacgtagaccaccgtagtccg

SEQ ID NO: 144224 - DNA, 679 bp, Homo sapiens
  misc_feature: GYAE6OF01BF4IU.53.27.C05.1.454.CMB.1.raw
  modified_base (196)..(196): a, c, t, g, unknown or other
  misc_feature (196)..(196): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtagganacagagtcaccatcacttgccggcaagtcagatcattggaatcaatttaatggtatcagcagaaaccaggacaacgcccctaatacttctgatcgttggctgacaaactactttgactaaaggtcgggtacctaagtcgtaaaggttcaagttgggaccaggtggtactcgtaggggtaacaggtaatttcccgaacttcgtaccgtaacggtaactaccgtaaactacgtacgttcgaaccgtacggtcttaacggtacgttacgttttaccggaaccttaacccgttaacttaccgttacgtaaccgtaacgttaacggtaacgtttaacccgtacggttttaccccggttaccggttaaccgttccgggaacccgtaacgggtacccggaaccgggttaggaacgttagtaaccggaaggtaacccgtaaaccgttgggtaccggtaccgttacgtacccgtaacccgtagtttacccgg

SEQ ID NO: 144225 - DNA, 551 bp, Homo sapiens
  misc_feature: GYAE6OF01AGBZM.53.27.C05.1.454.CMB.1.raw
  modified_base (222)..(222): a, c, t, g, unknown or other
  misc_feature (222)..(222): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccggganaagtcagatcattggaactcctaatttaaatggtatcagacaagaaccaggacaacgacccctaatactctgattcgttgctgactaaactactttagacgtaaaggtcgggtaccatacgaagttcaggtcgcaggtgatcgtgggacagtatcactcacacgtactacacagtctagcaggcgtagtacgtatttcgacctaacctactacgtgtactaacgagtacttaccgtacgtttcccgtacggtaccgtacgaccgaacggtaccgaggtaggacgtactacgaccgacgtacgtcggtacgtacgtcgacacgtcgttcg

SEQ ID NO: 144226 - DNA, 667 bp, Homo sapiens
  misc_feature: GYAE6OF01CZX6S.53.27.C05.1.454.CMB.1.raw
  modified_base (231)..(231): a, c, t, g, unknown or other
  misc_feature (231)..(231): n is a, c, g, or t
tcagcgcgtatacacacgaccggtgctcgatttagacgcgatcgaagggtttgggggagtcagtctcagtcaggacacagcatggacatgagggtccccgctcagctccgtgggctcctgctactctggctccgagatgccaattgtgacatccagatcgacccagtctccatccctccctgtcagcatctgtaggagacagagtcaccatcacttggccggcaagtcagntcagttagatacctatttaatggtatcagcaagaacagacaacgcccctaatacttctgatcgtgctagactaactacgttacgacgtaagtcgggtaccagtacgtaaggttacgaggtgacgtagtacggtatcgtaggactagtaacttctaccgtactacactactacaacgtacgttccgtagaccgtacggtacgtaggtaaccgtttaagttttaccggaaccttaaacccgtttaacctaaccttacggttaacccaaacgtagggtttaaacccgttaccgtttacccgggtttacccgttaccggggtacggttaacccgggtaccggtaaaaccgggtccgggtaggtaacgggtacggaaccgttacggtacggtaccggttaacgttggtaccggtacgtaccggacctaacgtccttacccg

SEQ ID NO: 144227 - DNA, 753 bp, Homo sapiens
  misc_feature: GYAE6OF01C7NEG.53.27.C05.1.454.CMB.1.raw
  modified_base (197)..(197): a, c, t, g, unknown or other
  misc_feature (197)..(197): n is a, c, g, or t
  modified_base (747)..(747): a, c, t, g, unknown or other
  misc_feature (747)..(747): n is a, c, g, or t
tcagcgcgtatacacacgaccggtgctcgatttagacgcgatcgaagggtttgggggagtcagtctcagtcaggacacagcatggacatgagggtccccgctcagctccgtggggctcctgctactctggctccgagatgccaattgtgacatccagatgacccagtctccatccctcctgtcagcatctgtagganacagacgtcaccatcacttcggccggacaacggtcaagtatcaagttaggaacttacctaattttaaagttaggttaatccgaagacgaaacggaaaacccgaaggaaaccaaaccgtaccccctaaattaacgtttaccgtaggtaacttccgttagggtaccttacggtaacctaaaaccgttacgttttacgaaacggttaaaacgggttaccggggtacccctaaagttaccgtaaacgggtttacgaaggttcggaccgtaaggtcggtaacgttaccgtacggggtaactaaggttaaacttccgtaaccttccgtaacgtaacgtaactaccgaaacgttacggtacttacggacgtaacggtacttacggttaacggttactttttacggaacccttaaaccgttactaaccgttacgtaacgtaaccgtacggttaaacgttaccgttaccgtttacccgtacggtaccgttacggaccgtaacggaccgtaggtcggaagactacgaacgtacgtaacgtggtcggactacgactaccgngttccg

SEQ ID NO: 144228 - DNA, 535 bp, Homo sapiens
  misc_feature: GYAE6OF01A19G1.53.27.C05.1.454.CMB.1.raw
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaatggtatcagcagaaaccaggacaagcccctaatattctgatcttggctgcaaacnctttgcaaagtgggtccatcaaggttcagtggcagtgatctgggacagaattcactctcacgatcaacngtctgcaggctgacgtatttcgactaacctactactgtacaactagtagttacacgtttccctacgggtaccgttcgggaccgtaacgggacccgtaacgggtggtaacgagtacgaacggtacgtaacgttggtacgggtctacggcctaccctagttaccg

SEQ ID NO: 144229 - DNA, 619 bp, Homo sapiens
  misc_feature: GYAE6OF01CR1N5.53.27.C05.1.454.CMB.1.raw
  modified_base (101)..(101): a, c, t, g, unknown or other
  misc_feature (101)..(101): n is a, c, g, or t
  modified_base (222)..(222): a, c, t, g, unknown or other
  misc_feature (222)..(222): n is a, c, g, or t
  modified_base (569)..(569): a, c, t, g, unknown or other
  misc_feature (569)..(569): n is a, c, g, or t
tcagcgcgtatacacacgaccggtgctcgatttagacgcgatcgaagggtttgggggagtcagtctcagtcaggacacagcatggacatgagggtccccgntcagctcctgggctcctgctactctggctccgagatgccaattgtgacatccagatgacccagtcctccatccctcctgtcagcatctgtaggagacagagtccacatcacttgccggganaagtcagatcagttaggactcctatttaaattggtatcagtcaagaaaccaggaacaacgaccccgttaattattccgtagtacttcgttaggctacgactaaactacttagacgtaaggtcgggtacctatacgtaaggttcaggttcggactaggtggtaatcgtagggaactagtactactactactacagtactacaacgtacgttcaggactagggtctacggtaacgttacgtttacgaaccctaacgttaacctacgtagtaaccaacgtacgtacgttaccgtacgtttcccgacggtaccgttaccggaacgaacgggtaccgtacggtggaacgtanaacgtaacgacgtaacgttggtcggtaccctaggacctccgtgttacccg

SEQ ID NO: 144230 - DNA, 673 bp, Homo sapiens
  misc_feature: GYAE6OF01D6CA7.53.27.C05.1.454.CMB.1.raw
  modified_base (169)..(169): a, c, t, g, unknown or other
  misc_feature (169)..(169): n is a, c, g, or t
tcagcgcgtatacacacgaccggtgctcgatttagacgcgatcgaagggtttgggggagtcagtctcagtcaggacacagcatggacatgagggtccccgctcagctccgtggggctcctgctactctggctccgagatgccaattgtgacatccagatgacccagtcnccatccctcctgtcagcatctgtaggagacagacgtcaaccatctacttcggacccggactaaggtcaagtatactagttaggaacttacctaagttttaaagttggttaatccgtaagacgaagaaaaccgagggaactaaaccgtaccccttaagttacttacgtacgtacttcgttggctcgaacctaaacgtacgtttacgacgtaaggtcgggtaccctagtaacgtacggttacgaaggtggactaaggtggtacgtcgtaggaactagtaaacttcctactcgtacacgagtacaacgtacgtcgtacgacgaggcgtagtactatttcgacctaacgttactagtacgtacaagtacgtaacgttacgtacgtttaccggtaccgtacggtaccggaaccggtaaccgggtaacggtaccgggttagggaaccgtaagtaccggtaacggtaccggtaacgttcggtaacgtccgtacgtaccgtacttcgtaccg

SEQ ID NO: 144231 - DNA, 598 bp, Homo sapiens
  misc_feature: GYAE6OF01ANMSS.53.27.C05.1.454.CMB.1.raw
  modified_base (102)..(102): a, c, t, g, unknown or other
  misc_feature (102)..(102): n is a, c, g, or t
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
tcagcgcgtatacacacgaccggtgctcgatttagacgcgatcgaagggtttgggggagtcagttctcagtcaggacacagcatggacatgagggtccccgntacagctccgtggggctcctgctactctggctccgagatgccaagttgtgacatccagatcgacccagtctccatcctcctgtcacgcatctgtaggagacagagtccaccntcacgtcgccggcaagtcagatcattgatcatttaatgtancagnagaacagacaacgccatntctgtatctgcngactaaactctttgactaaggtacggtccatcgaagttcagtggcagtaggctagtaggacgataacgttccgaactcgtacaacggtattacaaacttacggtctggaccgtagggttactacggtcgttaacttttcgacctaacccttactcctaacggttcaacgtacggtagtttaaccgttcgttccttaccggaccgttacggaaccccggtaagacccgtaagggtcccggtaagtactacggtacttaaccgaacggtttcggtaacgggtcgttaaccggaaccgtccgtagttaccgg

SEQ ID NO: 144232 - DNA, 597 bp, Homo sapiens
  misc_feature: GYAE6OF01EYC76.53.27.C05.1.454.CMB.1.raw
  modified_base (220)..(220): a, c, t, g, unknown or other
  misc_feature (220)..(220): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccggnaagtcagatcatggaatcctatttaaattgtatcagcagaaaccaggacaacgacccctaatattactgattcttggctagacaaactactttagacgtaaaggtcgggtacccaatacgtaaggttctaggtggacgtaggtggattcgtagggacagtaattcactactacacgtactacaacagtctacgacgaggctagacgttatttacgacctaaccttactacgtacgtaccaacgtagtacgttaccgtacgtttaccccgtacgggtaccgttaccggacccggtaacgggacccgtacggggtaggacggtagtaccgtaacggtacgaaacgttcgggttacggcgtacggcctaccgtagttccg

SEQ ID NO: 144233 - DNA, 791 bp, Homo sapiens
  misc_feature: GYAE6OF01EFOLZ.53.27.C05.1.454.CMB.1.raw
  modified_base (100)..(100): a, c, t, g, unknown or other
  misc_feature (100)..(100): n is a, c, g, or t
  modified_base (201)..(201): a, c, t, g, unknown or other
  misc_feature (201)..(201): n is a, c, g, or t
tcagcgcgtatacacacgaccggtgctcgatttagacgcgatcgaagggtttgggggagtcagtctcagtcaggacacagcatggacatgagggtccccnctcagctcctggggcctcctgctactctggctccgagatgcctaattgtgacatccagatcgacccagtcctccatccctcctgtcagcatcgtgtagganacagacgtaccaacctatcctacgttcggacccggataagtcaagtatactaattaggaacttcctaaattttaaacgttggtactcgacgaccaaacgaaacccgaggtaacctaacccgtaccccttaaattcgtttacgtaggactttaccggttggacctacggtaacctaaaacgttacgtttacggaaccggtaaacgggttccgggtaaccctaaggttaaccggtaacgggtttacgaagggtacgtacgtaacgggttaggtacgttaccgggtaagggaaaccctaagtaaaccctttccgtaccttaccgtaacctaaccgtaaccgtaactaaaccggttacgtaccgaggtacctaacgggtccgtttaacgttaaccgttaaccgttttccgaaccccgtttaaaccttacccgttaccgttaacgtaaccgtaaaccggttagtaacccggtttaccttaacccggtttacccggtacggtaccggtacccggaaccggtaagggacccgtagggtacggtacgtagtacggaacgtaccgtaagcggtcgtacctacgaccgtacctgttaccg

SEQ ID NO: 144234 - DNA, 545 bp, Homo sapiens
  misc_feature: GYAE6OF01ECSGI.53.27.C05.1.454.CMB.1.raw
  modified_base (221)..(221): a, c, t, g, unknown or other
  misc_feature (221)..(221): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttgccggnaagtcagatcattggaatccatttaatggtatcagcagaaacaggacaagcccctaatattctgatcttggctgacaaactactttgacaaagtcggggtacccatcaaggttcagtgcagtggatcgtagggacagaattcactctacacgatcaacagtctgcaggctagaacgtatttcgacctaactactactgtacaactagtaacgttactacgtttccctcgggtaccgttccggaccgtaaacggggaccgacgggtacgggaacgtagtacgaacggacgtaacgtcggtacggacctaggaccacgtcttaccg

SEQ ID NO: 144235 - DNA, 750 bp, Homo sapiens
  misc_feature: GYAE6OF01B4UQJ.53.27.C05.1.454.CMB.1.raw
  modified_base (200)..(200): a, c, t, g, unknown or other
  misc_feature (200)..(200): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtcctccactccctccctgtcagcatctgtagganacgagacgtccaccatccgtacgttcggcccgggacaacgttcgaagtatacctagtttacggtaaacttccttaaagttttaaagtttggtaattacgaacgtaccgaaacgaaaccgaacggaaccgaaccgtaccccttaaattacttcgtacgtacttcgttggtacctagaactaaaccgttacgtttacgaacgtaacggtccgggtacctagtacgtaggttcgaggtcgacgtaggtgtacgtcggaggactagtaacttcacgtactacaacgtactacgaacgtacgttacgcggtacgacggtacttacggtaacgtttacgtttaccgaacctttaaaccttacgttactaacgttaacctaaacggtacgttaccgtttaaccgtttaccggttttaccccggtacgggttaccggttacccgggaaccggtaaccgggtacccgggtaacgggttacgggtaacggtaacgtaaccggttaacggacccggttaagtccgggtacgttaccgacgacccgttcgtacgtttaccgg

SEQ ID NO: 144236 - DNA, 625 bp, Homo sapiens
  misc_feature: GYAE6OF01C070J.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttgccgggcaagtcagatcattggaatacctatttaaattggtatcagcagaaacagacaagaccctaatattctgatctcggctgactaactacttgacaaggtcgggtaccatacgtaaggttcaggtggacgagtggtactcgtaggacagtaactcacgtctacacgtatacaactagtcgtgtacgaggtctaggtacgttagttttacgacctaacccttacgtaccgttacgtaacctaacgtaagtaaccgtttactaaccggttttaccccggtaccgggtaccgttaccgggaacccggttaacggggtacccgtaacgggtcgggtaaaggtaacgtacggaaacggtaccggtaaaccgttgggtaccggtcgtaccggtaccctaacgtaccgtaccgg

SEQ ID NO: 144237 - DNA, 609 bp, Homo sapiens
  misc_feature: GYAE6OF01D9PD3.53.27.C05.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (322)..(322): a, c, t, g, unknown or other
  misc_feature (322)..(322): n is a, c, g, or t
  modified_base (511)..(511): a, c, t, g, unknown or other
  misc_feature (511)..(511): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtcctccatccctcctgtcagcatctagtagganacagagtcaccagtcacgttgccggnaagtcagatcataggaatcctaatttaaatgtatcagacaacgaaaccagaccaacgacccctaagtacttctagtattcgttggctagactaaactntttagactaaggtcgggtacctagtacgtaagttacgtaggtcgacgtaggtggaatcgtagggacaagtactccgactacgtacaacgatacgaaacgacgttcgagaccgaggtctacggattaacgtttcgaccttaacctacttactgtaacgtaacgtaggtaacctttagtaccgtttacccngggttacccttcgggaacccgtacggggtaaccgtagggtaccggtaatacgtaacgagaaccgtacgtacgtcggtacaccgtacaaccgttaccgg

SEQ ID NO: 144238 - DNA, 728 bp, Homo sapiens
  misc_feature: GYAE6OF01BY1UI.53.27.C05.1.454.CMB.1.raw
  modified_base (101)..(101): a, c, t, g, unknown or other
  misc_feature (101)..(101): n is a, c, g, or t
tcagcgcgtatacacacgaccggtgctcgatttagacgcgatcgaagggtttgggggagtcagtctcagtcaggacacagcatggacatgagggtccccgntcagctcctggggctcctgctactctggctccgagatgccaattgtgacatccagatcgacccagtcctccactccctccctgtcagcctatcgtgtaggagacagacgtccacatcacgttcggccgggacaagtcaagtatactagttacggaacttaccttaattttaaagttaggttaacttaccgaacggaccaacggaaaaccgaagggtaaaccaaaccgtaaccccctttaaattacgtttaccgtacgtaacgtttcgtttcggtacctacgtacctaaaacttaccgtttaggaacgtaaacgggtcgggtacctacgttacgtaacggttacgtaaggtcggtacgtaggttacgacgttacgtacgggaactaagttaacttcctaccgtctacgaacctacttaccaacgtacgtcgtacgacgtacggtacttaggtacttactttacgaccttaactacgtaccgtagtaaccaacgttagtaccgttaacgttaccggttcccgttacgggttaccgtacccggaaccggtaacgggtacccgtaacgggtacggtaacacgtacgaaaggtcccgtagttacggtcggtactacgacctagtccgttacg

SEQ ID NO: 144239 - DNA, 725 bp, Homo sapiens
  misc_feature: GYAE6OF01BOZSD.53.27.C05.1.454.CMB.1.raw
  modified_base (230)..(230): a, c, t, g, unknown or other
  misc_feature (230)..(230): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgacctaattgtacgactatccagactgacccagtctccatccctcctgtcagctatcgtgtagagacagagtcacctatcacgtcgccgganaagtcagtactcagtagaactaccgtaatttaaagttggtaatacgaacgacaacgaaaccgaacggaaccaacggggtaacccctaaattaacttactagtacgttcgttacggtacgtacgtaacctaaacctacgtttacgtaacgtaaacgggtaccgggtacctaacgttacgtaaacggttacgtaacggtacggtacgtacggtaggtacgtacgtacggtaacgtaagtaacgttactaccgttactacgaacgtactaaccgaacgtacgtacgtacgacgtacgtacgtacgtaacgttactttacgtaacctaaacttaacgttaaccgttacgtaacgtaacgtaacgttaacgttaaccgttaccgtttacccgtacggttaccggttacccggtacgtaaccgggtaccggtaacggtacggtacgtaacgacgaacgtacgtaacgtaggtaccgtacgtacgacgtaacctcgttaccg

SEQ ID NO: 144240 - DNA, 928 bp, Homo sapiens
  misc_feature: GYAE6OF01A2UAU.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagctatctgtaaggagacagagtcaccatcacttcggccgggacaacgtcaagactctagttggaattacctaattttaaattggtatacagacaacgaaaccaggaaccaaacgaccccttaaatactttacgtacgtacgttccgtttagggtaccttacggaacctaaaaccgttacggttttacggtaaaccgttaaaaaggggtttccggggtaaccccctaaacggttaaccgttaaaacggggtttaccgtaaacggggttacggggtaaccgttaacggggttacggggtaaacgtttccgggttaacgggggtaaacccgtaaacgggtttaaaacctttaacccgtaacccgtttaccgtttaacccggaaaccgttaaccgttaaacccgaaaaccgttaaggtttacccggtacggtaacccggaaggggtttccctttaaacgggtaaccggttttaactttttaccggaaaccctaaacccgttttaaccttaccgggtttaacgtaaccaaaaccgttacggttaaacggttttaccctttaacccggttttccccggtaccgggttaaaccgggtttccccgggaacccgggttaaaaccggggtacccggttaaaaccggggggttacggtaaaacgttacccgtaacggtaaacccgggtaaccggttaacgggttacggttaccgggacgttaaccggaccccgttaaaccgtcggtttaaccccg

SEQ ID NO: 144241 - DNA, 714 bp, Homo sapiens
  misc_feature: GYAE6OF01BV2O0.53.27.C05.1.454.CMB.1.raw
  modified_base (247)..(247): a, c, t, g, unknown or other
  misc_feature (247)..(247): n is a, c, g, or t
tcagcgcgtatacacacgaccggtgctcgatttagacgcgatcgaagggtttgggggagtcagtctcagtcaggacacagcatggacatggacgggtccccgctcagctccgtggggctcctgctactctggctccgagatcgcctaattgtagaacatccaggatcgacccagtcctccacttccctcccgtgtcagctagtcgtaggtaaggacgacagacgtcacctatctacgtcggccgganagtcaagactcagttagactactaatttaagtgtatcagacaacgaacgagacaacgtaccctaatacttctgtattcgtaggctacgaactaacgttacttacggaacgtaacggtccggtacctaagtacgtaacggttcgaggtcggtacgtaggtggtacgtacggtacgggtaactaacgtacttacgacttacctacgtaacgtacgtaacgtacgtacgtacgtacgaccggtaggtacgttacggtacgtttacgtttacgaaccctttaacctacgttacgttactaacctaacggttaacgttaaccgtttaccgttaaccggttttcccgtaccgggttaccgtaacccggtaccgggtaaaccggtaccggttacgggtacgggtaacgtacggtaacggaacggtaccggttaacgtcggtacgggtacctacgggaccttacgtacgttaccg

SEQ ID NO: 144242 - DNA, 751 bp, Homo sapiens
  misc_feature: GYAE6OF01DUTLK.53.27.C05.1.454.CMB.1.raw
  modified_base (101)..(101): a, c, t, g, unknown or other
  misc_feature (101)..(101): n is a, c, g, or t
  modified_base (281)..(281): a, c, t, g, unknown or other
  misc_feature (281)..(281): n is a, c, g, or t
tcagcgcgtatacacacgaccggtgctcgatttagacgcgatcgaagggtttgggggagtcagtctcagtcaggacacagcatggacatgagggtccccgntcagctccgtgggctcctgctactctggctccgagatcgacctaagttgtacgactactccgaagtacgtaccgaacccctagtccctaccctacttcccctcccgtgtccgacgtctagtcgtaggtaggacgaacgagtacgtaccaacctataccgtacggttccggacccgggtanaacggtcaagtactacgtagttacggaacttaccgttaaagttttaagtaggtacctacgacggtaaccgaaaccggtaaaccgacggaaaccgtaacccgttaacccttaattaccgttcgtaacgtcgtttacggtacggtacctaacgtaaccgtaaaccgttcgttacggaaccggtaacgggttccggtacctaagtaccgtagtacggtaggtcgacgtggtagtcgtacggaggtaactacggtactcaccgtcaacgtacgaactaccgaagttcgcgtacggacgtaggtcgtaagtacgttccgttacgacccttaacgtataccgaactaacgtaaccgagtttccgttacgtacccggttaccgacggttccgtaacggccggtaacggtacgggtagtaccggactacgtacgacggacgttaggcgtccgtacaaccgtcctaaccgtgtttcccg

SEQ ID NO: 144243 - DNA, 774 bp, Homo sapiens
  misc_feature: GYAE6OF01EL06O.53.27.C05.1.454.CMB.1.raw
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
tcagcgcgtatacacacgaccggtgctcgatttagacgcgatcgaagggtttggggggagtcagtctcagtcaggacacagcatggacatgagggtccccgctcagctcctggggctcctgctactctggctcgagatgcctaattgtgacatccagatcgaccctagtcctccactccctccctgtcagctatcgtaggtaggganacgagtacgtccaaccatcacgttcggccggacaagtcgagntacgtagttagtaactacctaaattttaaagtggtactacaagactaaacgaaaccgaaggaaccaacgtaccccttaaagttacttacgtagtacttcgtcggtactacgaacctaaactacgtttacgaaccgtaaagggttccggacctaataccggtaagttcgaacggtcggactagggtacgtacgtacggtagggaactaacggttaactcgtactaccgtactaacggtaactacgtaacgtacgtacgttacgacggtaacggtctttaagggaacgtttaacgtttacccgaaacctttaacccttaacgttaacttacgtaaaccgtaaactacggtttaacctaaccggtttacccggttttaccgacccgggttaaaccggttacccgggtaaaccgggtaaaccggttacccggggaaacggtttaaccggggaacgtaaaccgtaaccggtaaacggtaaccggggtacttacgggtccgtaacgtaccgtaccgacctaggtttacccg

SEQ ID NO: 144244 - DNA, 888 bp, Homo sapiens
  misc_feature: GYAE6OF01CTV49.53.27.C05.1.454.CMB.1.raw
tcagcgcgtatacacacgaccggtgctcgatttagacgcgatcgaagggtttgggggagtcagtctcagtcaggacacagcatggacatgacgggtccccgctcagctccgtgggcctcctgctactctggctccgagatgcctaattgtgacatccagatcgacccagtctccactccctcctgtcacgcatctaggtaacggagacgaagacgtaccaacctaacttccgtaccgtttaccgggccccggggtaactaaacggttaccgaaaggtaactttaccgtaagtttaacgggtaaacctttaaccgtttaaaagtttttaaaacgtttacgggttaacctaaccgtaaacggaaccgaaaaccggaaaaacccggaaacgggtaaaccctaaaccggttaaccccctttaaaatttactttaccgttacggttacgttcggttacggtaccgttaacgaaaccgttaaaaccgttacgtttacggaacggttaaacggggttaccgggtaccctaacgttaacggttaaacggttacgtaacggtcgggtaacgtacggtacggtaacgttaccgggtaacgggtaacgtaaacgttaacgttacctacgttacccttaaccggaacgttaactaaccgtaaacgtcggttactacgtacggtacggtacgtaacggtacgtttaacgttacccgtaaccttaaccgtacttaaccgtacgtaaacgtaacgtacggttaacgtttacccgttaccggtttacccgtaccgggttaccggttacccggaaaccggtaccggaccgtagtaaccgggtaagaacgtacgtacgaaacggtacgttacgtacgggttacgcgtaaccgtacgtaccgttacg

SEQ ID NO: 144245 - DNA, 685 bp, Homo sapiens
  misc_feature: GYAE6OF01B6P6R.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtccaccatcacttgccgggcaagtcagatcattggaactcctaattttaaattggtatcagacaagaaaccaggaaccaacgaccccctaaattacttctagtaacttcgttaggtctacgacctaaaacctacgttttagacgtaaacgggttcggggtacccctaagtaccgtaaagggttcaaggtcggacgtaggtcggtactcgtagggactaagtaacttcgaacttcgtacaacgtataccaaacgtacgtcctagcgtaaggtcgtacggtaacgttagttttacgacctaaacccttacgtacttacgtaccgtaaacgtacggttaacgtttaccctacggttttaccccgtacgggtacccggttaccggaccggtaaccgggaccggtaacggggtacggtaacgtaccgtaacggaaacggtaccggtaacgttcgggtacggtcctacggacctaaccgtcgttacccg

SEQ ID NO: 144246 - DNA, 905 bp, Homo sapiens
  misc_feature: GYAE6OF01EHTWV.53.27.C05.1.454.CMB.1.raw
  modified_base (150)..(150): a, c, t, g, unknown or other
  misc_feature (150)..(150): n is a, c, g, or t
tcagcgcgtatacacacgaccggtgctcgatttagacgcgatcgaagggtttgggggagtcagtctcagtcaggacacagcatggacatgagggtccccgctcagctccgtggggctcctgctactctggcctccgagatgcctaattgngactataccaggatcgacccagtctccattccctccctgtccaagctacttcgtaggtaaggacaaccagtagtaccaacctattcctaacgttcgggacccggggactaaaggtcaaggtacttcgaagttaggaacttaccgttaattttaaagttaggtaactacgaacgacgaaacgaaaacccgtaaggaacctaaacgtacccctaaattactttaccgtagtacgttccgttaggtacctaacggtaaccctaaaagtttaccgttttacggaaaccggttaaaacgggttaccggggtaacccctaagttaaaccggtaaggttacgtaacggtacgggtacgtaacgggtcggtaacgttacggtacggggtaaactaaacggtaaacttccgtaaccttaccgtaacgtaacgtaacttacgaaacgttaccgtacgaacggacgtaacggggtactttaaccggtaacggttttaccgttttaacgaaccgttaaaccgttttaacgttaaccgttacgttaacccgtaaaacgtaccgggtttaactttaacccggtttaaccggtttaccccggttaacggggtaaccccggttaccggtaaaacccgggttaaccgggggtacccggaaaaccggggtttaacggggtaacgtaaacgggttaaccgaaacggtaaacccggggtaagttaacccgggtcgtaaccgttaccgggacccttaaaccgtacgttaaacccgg

SEQ ID NO: 144247 - DNA, 819 bp, Homo sapiens
  misc_feature: GYAE6OF01BB773.53.27.C05.1.454.CMB.1.raw
  modified_base (101)..(101): a, c, t, g, unknown or other
  misc_feature (101)..(101): n is a, c, g, or t
tcagcgcgtatacacacgaccggtgctcgatttagacgcgatcgaagggtttgggggagtcagtctcagtcaggacacagcatggacatgagggtccccgntcagctcctgggctccctgctactctggctccgagatgccaattgtgacatccagatgacccagtctccatcccgtcctgtcagcatcgtagtaggagacagacgtcaccatccacgttcgccgggtacaagtcaggtatacgtaagtttacggaactaccttaaagttttaaaacgtttagggtaacttcgaaacgtaccgaaaaggaaaaccccgtaaggggaaccccaaacggtaaccccctttaaattaccgtttacgtacgtaacgtttacgtttccgggtaccgtacgtaaccgttaaaaccgtaaccggtttttacggaaacgttaaaacgggttcccggggtaacccttaaacgtaaccgttaaaggggtttacctaagggtacggtaaccgttaaggtagggtaactttaccgggtagggtaactaaacgttaacgtttacgtaacctccttaaccggaactaacgttaacaaacgtagttaccgagacgtacgtatacggttaacttacgtttacgacccttaaacgttaacctaacggttaacgaactaaacgttaccggtaacgtttaacctaccggttttacccgccggtaacgttcccggaaccggtaaacgggtacggtaaccgggttaggaaacggttaaccgtaacgtaacggaacccgttagaccggttaacgacggtactaccgtaaccgtaacgtccg

SEQ ID NO: 144248 - DNA, 615 bp, Homo sapiens
  misc_feature: GYAE6OF01CD2VT.53.27.C05.1.454.CMB.1.raw
  modified_base (101)..(101): a, c, t, g, unknown or other
  misc_feature (101)..(101): n is a, c, g, or t
  modified_base (223)..(223): a, c, t, g, unknown or other
  misc_feature (223)..(223): n is a, c, g, or t
tcagcgcgtatacacacgaccggtgctcgatttagacgcgatcgaagggtttgggggagtcagtctcagtcaggacacagcatggacatgagggtccccgntcagctccgtggggctcctgctactctggctccgagatgccaattgtgacatccagatgacccagtctccatcctccctgtcagcatctgtaggagacagagtcacatcacttcgccggganaagtcagatcattgaatcctaatttaatgtatcagtacagaacaggacaacgacccctaatacttctgatcgttggctagactaaactacgtttcgacgtaaaggtcgggtacccagttacgtaacggttcgaggtggactaggtggtagtcgtaggtacaagtaattctactctacacgtactacaacgtgtacgtagacgtaggctaggtaacgttagttttacgaccgtaaaccttacgttacgtacgttaccaaacgtacgtaacgttaccgttacgtttacccgtaccggttacgttaccggaccggtaacgggaaccggtacggtaggaacgtacgtaacggtaaggaccgtaacgtcggtacgtacgtacgacctacctgtaccg

SEQ ID NO: 144249 - DNA, 711 bp, Homo sapiens
  misc_feature: GYAE6OF01B3YHR.53.27.C05.1.454.CMB.1.raw
  modified_base (197)..(197): a, c, t, g, unknown or other
  misc_feature (197)..(197): n is a, c, g, or t
tcagcgcgtatacacacgaccggtgctcgatttagacgcgatcgaagggtttgggggagtcagtctcagtcaggacacagcatggacatggagggtccccgctcagctccgtggggctcctgctactctggctcgagatgccaattgtgacatccagatgaccagtctccatccctcctagcagcatcgtgaggganacgagtacgtcaccatcacgttcggccgggacaagtcaagatcgatggaatctaatttaatggtatacagacaagaacagacaacgaccctaatacttcagtatcgtaggctagacaaacgtgtttacgacgtaaaggtcgggtacctaagtacgtaaaggttcgaaggtacggacgtaggtacggaactttacgacgggaaactaagtaaacgtttacccgacgttaccgtaacgttaacgaacgttacgaaaccgttaacgtacgtaacggacgttaacggacgtacggtaacgttaacgtttacgaacctaaccgttactacgttacaaccgtaaacgtaacgttaacggttaaccttacggtttacccggttacggtaaccggttaccggtaaacccggtaaaccggtacccgggtaaaccgggttacggtaaacgtaacgtaacggttaacggaaccgtaacggtacgggtacggaccgttacggacccttaaacggtacgttacccgg

SEQ ID NO: 144250 - DNA, 622 bp, Homo sapiens
  misc_feature: GYAE6OF01DW8BL.53.27.C05.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
tcagcgcgtatacacacgaccggtgctcgatttagacgcgatcgaagggtttgggggagtcagtctcagtcaggacacagcatggacatgagggtccccgctcagctccgtggggctcctgctactctggctccgagatgccaattgtgacatccagatgacccagtctccatccctccctgtcagcatctgtagganacagacgtcaccatcacgttcggccggganaagtcagactctagttaggaactcctaattttaaagttggtatcagacgaacgaaaccgaggaacaacgtacccctaattattctgtacttcgttggctagactaaactcgtttacgacgtaaaggttcgggtacctagttacgtaaggttcaggtcggacgtaggtgacgtacgtagggaactaagtacttccacttctacgactactaccaacgtgtactggcacggtctgtaacgttagtttacgacctaaccttactacgtacgtacctaatacgtacgtttaccttacgtttccccgtaggtaccggttaccggaccgaacgggtaccgacgggtagtacgagtaacgacgtacgtaacgtggtcgacgtagacccgtacgtcgttccg

SEQ ID NO: 144251 - DNA, 904 bp, Homo sapiens
  misc_feature: GYAE6OF01BQMFX.53.27.C05.1.454.CMB.1.raw
  modified_base (884)..(884): a, c, t, g, unknown or other
  misc_feature (884)..(884): n is a, c, g, or t
tcagcgcgtatacacacgaccggtgctcgatttagacgcgatcgaagggtttgggggagtcagtctcagtcaggacacagcatggacatgacgggtccccgctcagcctccgtggggctcctgctactctggctccgagatgccaattgtgactatccagtatcgtacctagtcctccacttccctcctgtcagctatcgtggtaaggacgacgaggacgtaccacctatccgtacgttcggccgggactacgtcgagtactcgtagttacggtaacttacgttaaagttttaagttaggtaacttacgaacgtaaccaaaacggaaaaccgtacgggaaacctaacccggttaaccccttaaagttaccgtttacgtaacggtacgtttacggtacgggtacttaccggtaaaccttaaacgtttaccggtttacggaaaccggttaaacggggttccgggtacccttaacgttaacggttaacgggttccgtaaggggttacggaccggttaagggttcggtaaccgttacggggtaacgggtaaaccttaaagggttaacctttaccggtaaccctttaccgtaacccggttaaacggtaaaccttaaccggtaaaccgttaacggttacccggttaacgggaacggttaacgggtccgttaaccggttacgtttaaccgtttaccggaaacccctttaaacccggtttacttaaccgtaacggttaaccctaaaggttaccggtttaacggtttacccgttacccggttacccggtaaccgggtaccggtaccgggtaaacccgtaccggggtaaccggtttacggggaataacccggtaagaaccggtaacggtacgtaggttcggacgttaccggtanaaccgtcgttaacgttccgg

SEQ ID NO: 144252 - DNA, 870 bp, Homo sapiens
  misc_feature: GYAE6OF01BY2AI.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctccgtgggctcctgctactctggctccgagatgccaattgtgacatccagatcgacccagtcctccactccctcccgtgtcagctatcgtggtaaggagacagacgtaccacctatcctacttcggacccggactaagtcagactacgtaagttaggaacttcccgttaaatttttaaagttgggttaactaccgagtaaccaaacggaaacccgtagggaaccaaccggtaccccctttaaagttacttaccgttagtacttcgttaggacctagaacctaaaccttacgtttacgaacgtaaacgggtcccggtaacctactaccgttaaggtttcgtacggttaggaccgtagggttacggtacgttacgggtacgggtaaccgtaaggttaactttaccgaaccgtttaccgtaaccgtaaccgtaactaaccgtaaactacgggttacgtacgggacgtaacggttccggtttaaaggtaacccgtttttgtttaaccccggtaaccgtttaaaccccgtttaccttaaccgttaccggttaaaccgtaaccgggtttaaacggtaaccgtttaccccggtttaaccgttttccccgggtaaccggttccgggttaaccccggaaccgggttaaccggggtaaccccggttaacggggttcggtaaaccggttaccgtaaaccgggtaccggaacccgttaacgggcggtttaaccgggtccgtaccccggtaacccgaccgtttaccggtttacccgg

SEQ ID NO: 144253 - DNA, 691 bp, Homo sapiens
  misc_feature: GYAE6OF01DG89A.53.27.C05.1.454.CMB.1.raw
  modified_base (99)..(99): a, c, t, g, unknown or other
  misc_feature (99)..(99): n is a, c, g, or t
  modified_base (243)..(243): a, c, t, g, unknown or other
  misc_feature (243)..(243): n is a, c, g, or t
tcagcgcgtatacacacgaccggtgctcgatttagacgcgatcgaagggtttggggagtcagtctcagtcaggacacagcatggacatgaggtccccgntcagctcctgggctcctgctactctggcctccgagatgccaattgtgaacatccagactcgacccagtcctccatccctcccgtgtccagcatctggaggagacagacgtacacctatcacgttcgccggactaaggtccaggntacgaagttaggactaccttaagtttaacgttggttactcgacgtacgaacgtaaaccgaggaacctaaccgtacccctaattacttcgtagtagttccgtcggactcggtaactaacgtcgtttagaccgtaaggtccggtacctagttacggaacggttcgtaggtacggtacgtaggtcgtacgtcggtacggaataacgttactacgtacgtctaccgacggtaactacgaaacgtcgttacgtacgacgtaggtcgtacggtaagtttaccttacgaaccttacctcgttaaccttcgaaccgtaattaccggttaccgtttaacccggtccgtttccgttaccggtaccgtacgggtaacccgtacgggtacccgtagggtcgtaacgcgttaactacggacgttgaccggtacggttccactcgtaacccgtgtttacccg

SEQ ID NO: 144254 - DNA, 771 bp, Homo sapiens
  misc_feature: GYAE6OF01CFXHH.53.27.C05.1.454.CMB.1.raw
  modified_base (100)..(100): a, c, t, g, unknown or other
  misc_feature (100)..(100): n is a, c, g, or t
tcagcgcgtatacacacgaccggtgctcgatttagacgcgatcgaagggtttgggggagtcagtctcagtcaggacacagcatggacatgagggtccccntcagctcctgggctcctgctactctggctcgagatgccaattgtgacatccagatgacccagtcctccatccctccctgtcagctatcgtgtaaggacgacagtacgtaccacctatcgacgttcggccgggactaagtccagtactactagttaggaacttacctaattttaaagttggtaactacagtacaaacggaaaccaggtaaccaacggtaccccttaagttacttctagtaacttcgttaggtactacggaacctaaacgtactttaggaaccgtaaaacgggtccgggtaacctaagttacgtaaggttcgaaggttcggacgtaggtagtacgttcggtagggtaactaaggttacgttacctacgttaccgtaccgtaacgtaccgtaaccgtaaacgttcggtccgttacggacgtaccgggttacttacggttaacgttacgtttaccgtaaccgtaaccgttaccgtaacgttaccgaaccttaaggtaccgttaaggtttacccgttaccgttttcccggaaccgggttaccgttaccgggaacccggtaacggggtaacccgtaacgggtacgggttaaaccgtaaggttaaccggtaacgggtacggtaacgttcgggtaacgtcccgtaagtaccctacggtacgtttacccg

SEQ ID NO: 144255 - DNA, 840 bp, Homo sapiens
  misc_feature: GYAE6OF01DAXPR.53.27.C05.1.454.CMB.1.raw
  modified_base (101)..(101): a, c, t, g, unknown or other
  misc_feature (101)..(101): n is a, c, g, or t
tcagcgcgtatacacacgaccggtgctcgatttagacgcgatcgaagggtttgggggagtcagtctcagtcaggacacagcatggacatgagggtccccgntcagctcctggggctcctgctactctggctccggagatgccaattgtgacatccagatgacccagtctccatccctccctgtcagctatctagtaggagacagagtccaccatactacgttcggccgggacaaggtcaagtattcgtagtttacggaacttaccttaatttttaaaagtttgggttaacttacgaaggtaccaaacggaaaacccgaacgggaacctaaacggtaaccccctttaaaatttactttacgtagtacgttccgtttacgggcctacgaacctaaaaccgtacgttttacggaaccgttaaaacgggttccggggttaaccctaacgttaccggtaaacgggtttacgaacgggttagggaccgttaagggtacgggttaacttaccgggtacggggtaactaaacggttaaacttacccgtacgtttacccgtaaccgtaaccgtaacttacgaaacgtacgttaccgtacggaccgtacgggtcttacgggtaaccgtttaactttacgaaccttaaacccttacgttaacgtcgttaaaccgaaacgttaacgttaaccggtttaccgttaccgttttaccccggttacgggttaccggttacccgggaacccgtaaacggggtcccggtaacgggtacgggtaacgtaacttaccgaaacggtttccggtaaacggttcggtcggttaaccgtagtccccgaaccgttcgtttacccg

SEQ ID NO: 144256 - DNA, 742 bp, Homo sapiens
  misc_feature: GYAE6OF01C0JGX.53.27.C05.1.454.CMB.1.raw
  modified_base (698)..(698): a, c, t, g, unknown or other
  misc_feature (698)..(698): n is a, c, g, or t
  modified_base (720)..(720): a, c, t, g, unknown or other
  misc_feature (720)..(720): n is a, c, g, or t
  modified_base (736)..(736): a, c, t, g, unknown or other
  misc_feature (736)..(736): n is a, c, g, or t
tcagcgcgtatacacacgaccggtgctcgatttagacgcgatcgaaggggtttgggggagtcagtctcagtcaggacacagcatggacatggacgggtccccgctcagctccgtggggcttcctcgctactcgtggcctcgagatcgacctattgtcgacactaccagtatacgaccgacttccacctactccctcctcgtacacgctatcgtaggaggacgacagtactaccactagtcctcgtcggaccggacgtacgtcagtacgtacgtagttacgaacttacttaagtttaacgttggtaatacgaacgaaccaacgaaccgggaaacgaaccgtaaccgttaacccttaatttaccgttgtacgttcgttacgtacggtactaacgaactttaacgttacgtacggtaccggtaagggttaccgtaaccttacggttaagtacgggttacaacgggtcggtaagtggggttagtacgggtttacggaccgggtttaacgaaaccgtttactttaccgtaccgttaccgtaaccgacgttaacgaacgttaacgtcgttcggacgacggtacgtacgttacgtacttacgtacctacttaccgttactacgtactaatacgtacgtacgttactaccgttaccggtacggtccgtaacggtaccggacgaccgtagggtacgtataacggtanacggtacggttactcgggtacncgggtacacccgtgtntcccgg

SEQ ID NO: 144257 - DNA, 749 bp, Homo sapiens
  misc_feature: GYAE6OF01E2378.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgaccccagtctccatcctccctgtcagcatctgtaggagacagagtcaccatccacttggacccgggcaagtcagatactattggaataccctaattttaaaacttggtaattcgagacaagaaaacccaagggaaccaaacgacccccgtaaattactttactaggaacttcgttggcctagacctaaactactttacgaacgtaaaacggttacgggggtacccctaagtactaaacgggtttccgtaagggtacggtacgaggttacgggtaagttccgtacggggtaactaaacggtaaagtttacccctaaccttacgtacccgtaaccggtaacttaaccgtaaaccgtaagtttaccgtacgggacgtaacgggttacccgtaggtaaccggtttaacgtttttccggaacctaaacccgttaactaaccgttcgtaccaaacgtaacgtaacgtttacctacgttttcccgtaccgggtacgttaccggaccggaaacgggtaacccgacgggtacgggacgtaacgtacgtaaacgaccggtaacgttacgggtacggttcgacgtccgaccgtacgttccg

SEQ ID NO: 144258 - DNA, 670 bp, Homo sapiens
  misc_feature: GYAE6OF01BFPUZ.53.27.C05.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
tcagcgcgtatacacacgaccggtgctcgatttagacgcgatcgaagggtttgggggagtcagtcgtcagtcaggacacagcatggacatgagggtccccgntcagctcctggggctcctgctactctggctccgagatgccaattgtgacatccagatgacccgagtctccatccctcctgtcagcatctgtagganacagagttcaccatccacgttcgccgggcaagtcagatcatgaatctattaatgtatcancagaaccaggacacgccctatattctgatcttgctcgactaactacgtttagacgtaaaggtcgggtaccagtacgaacgttcgacggtcggtacgaggtaggtacgtcgtacggggaacaagtaacttccaacttcctcctaacgtactaccaacgtacgtacctcggacgtaggtcgtacggtacgtttagtttacgacctaaaccgtttacttacctacggtaacctaaacggaacgttaacggtttacccgttaccggttttaccccgtaccgggtaaccggtttcccggtaacccggtaaacgggtacccggtaacgggttaacgggtacgtaacgttaccggaaacggtaccggtaaacgttccgggtacggtacgttaccggacccttaaccgtcgtttacccgg

SEQ ID NO: 144259 - DNA, 805 bp, Homo sapiens
  misc_feature: GYAE6OF01ERPKX.53.27.C05.1.454.CMB.1.raw
  modified_base (553)..(553): a, c, t, g, unknown or other
  misc_feature (553)..(553): n is a, c, g, or t
tcagcgcgtatacacacgaccggtgctcgatttagacgcgatcgaagggtttgggggagtcagtctcagtcaggacacagcatggacatgagggtcccccgctcagctccgtggggcctcctgctactcgtggctccgagatcgccaagttgtcgacactaccgagatcgaccctacgtctaccactccctcctgtcacgctactcgtaggtaggacgacgagtacgtaccaccgtataccgtacgttcggacccgggactaaggtacaagacttcctaaggttacggaaacttaccttaagttttaaaggttacggttaactaccgaaggtaacccgaaacggtaaaacccggaacggtaacctaaacccgtaccccgtttaaacttacgtttaccgttagtacgtttccgttcggtacttacgaactaaacgttacgtttacgtaaccgtaacgggtccggtaacctagtacgtaacggttactaggtacggtcgtaggtcgtagtcggtacgggaactaagtacgttactacgtacctacgaaccgttanaaccgtaactgttaccgagtaccggttggtaccgttagttacctttacgtttacgaaccccgttaaccgttaccgttaactacggtaacccggtaacgtaaccgttaccggtttaacgttacccgtttaccggtaccgggtaccgggttacccgaaccggggttaccggtaaccccgggtaaggtaccggactaaccgggtaatacccggaaacggtcttacgggacggttcctacgacctcgttacgtacg

SEQ ID NO: 144260 - DNA, 714 bp, Homo sapiens
  misc_feature: GYAE6OF01C6YXJ.53.27.C05.1.454.CMB.1.raw
  modified_base (101)..(101): a, c, t, g, unknown or other
  misc_feature (101)..(101): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (368)..(368): a, c, t, g, unknown or other
  misc_feature (368)..(368): n is a, c, g, or t
  modified_base (418)..(418): a, c, t, g, unknown or other
  misc_feature (418)..(418): n is a, c, g, or t
tcagcgcgtatacacacgaccggtgctcgatttagacgcgatcgaagggtttgggggagtcagtctcagtcaggacacagcatggacatgacgggtccccntcagctccgtggggctcctgctactcgtggcctccggagtatcgacctaatttgtgactatccaagactcgaccctagtcctccacttccccgtcccttgtcacgctatcgtaggaggacagagcgtaccacntccncgttcggaccgganagtccagatactagttacgactacttaatttaagttggatacagacaaacgaacgagaaccaacgtaccctaattacgttctagtacttcgtacgtccgtacgtaacctaacgttnttacggaacggttaacgggtccgggtaacctacgttaacggtaaggtttnagggtacgcggtaggtcggtacgtacggacggtaactacgttactccgtaacttaccgtaccgaaacttaaccgaccgttaaacgccgtttcacggtaacgtcggtacgttagttacggttctaccgtaactacccttatacgtacgtaacgaacgttaaggttacttaccggttaccgttccggttacgtacggttaaccggaccggttaacgggacccggttacgggtacgacggtacgtaacggtcgtacccggtaatcgggtacggttcctacgacccgttagtgttacccg

SEQ ID NO: 144261 - DNA, 686 bp, Homo sapiens
  misc_feature: GYAE6OF01D2H3M.53.27.C05.1.454.CMB.1.raw
  modified_base (479)..(479): a, c, t, g, unknown or other
  misc_feature (479)..(479): n is a, c, g, or t
tcagcgcgtatacacacgaccggtgctcgatttagacgcgatcgaagggtttgggggagtcagtctcagtcaggacacagcatggacatgagggtcccccgctcagctcctggggcctcctgctactctggctccgagatgccaattgtgacatccagatcgacccagtcctccactccctccctgtcagcatctgtaggagacagatccaccatccacttcggccgggacaagtcagactacagttaggaactacctaattttaaaattggtacttacaagacaaacgaaaaccgaggaacctaacgaccccttaattattctagtattcgttggctagtacaaactacgtttagacgtaaaggtccgggtacctagtacgtaacgggttcaggtcggactagggtggacgttcggtaggaacgtaagttaacgttactactctaacgaccgtaataccgtaaaccgtacgttaccgngtacgacggtactacggtacgtttcgtttacgaaccctaaccgtttactacgtacgtaaccaagtaacgtaactttaccgttaaccggtttccctaccgggtaccggttaccggacccggtaaggtacccgtaagggttcggaagtaacgtaccgaaggtaccgtaacgttcgggtacggtacttcggacctacccgtagtttaccg

SEQ ID NO: 144262 - DNA, 704 bp, Homo sapiens
  misc_feature: GYAE6OF01CYSW6.53.27.C05.1.454.CMB.1.raw
  modified_base (87)..(87): a, c, t, g, unknown or other
  misc_feature (87)..(87): n is a, c, g, or t
  modified_base (101)..(101): a, c, t, g, unknown or other
  misc_feature (101)..(101): n is a, c, g, or t
  modified_base (447)..(447): a, c, t, g, unknown or other
  misc_feature (447)..(447): n is a, c, g, or t
  modified_base (691)..(691): a, c, t, g, unknown or other
  misc_feature (691)..(691): n is a, c, g, or t
tcagcgcgtatacacacgaccggtgctcgatttagacgcgatcgaagggtttgggggagtcagtctcagtcaggacacagcatgganatgagggtccccgntcagctccgtggggctcctgctactctggcctccgagatgacctaattgtgacatccagatcgacccagtcctccattccctccctgtcagctatcgtggtaggagactagacgtaccacattaccgacgttcgggacccgggtataacggtcagtacttacgagttacggaacttaacctttaagtttaagttcggtaatcgaagacgaaacggaaaccgtacggaaacctaacccgtaccccttaaatttcgttccgtagtacgtttcggttacggacttacgaactaaaccgttacgttcggaaccgtaaggggtccgtacctaagtaccgggtaagttacgnggtgtaccgtaggtacgtacgttcggaacggaaactagttacgtacctcttacgacgtaacttacgaacgtaaaccgtgttaccgaggacgtaccggtacttagggtaaccttttagtaccgaacccgttaacttccgtacgtacgtaactaacgtcgttaaacgttcgtaccgttacggtcgacgttcggaaccgtaggaccgtaggcgacgtagtacgacgtacgtagtggtaccgacgtanactcgtgttcccg

SEQ ID NO: 144263 - DNA, 786 bp, Homo sapiens
  misc_feature: GYAE6OF01C54J2.53.27.C05.1.454.CMB.1.raw
  modified_base (104)..(104): a, c, t, g, unknown or other
  misc_feature (104)..(104): n is a, c, g, or t
tcagcgcgtatacacacgaccggtgctcgatttagacgcgatcgaagggtttgggggagtcagtctcagtcaggacacagcagtggacatggacgggtcccccntacagtcctccggtgggcccttccctgacctactctggcctaccgagatcgacctaattggacacacgtccaaggactccgaccctatccctaccacgttcccctactggtaccaacgtctaacgtccggttaggaaggacaacgtaagtaccgtaccctaaccattccgtaacggttaccggacccggggaataacggtacaaagccttacgtaaggttaaccgtaaccttaacgttaaaagtttaagttacggtaactaaccggaacgaaacgaaacgaaaaccgaacgtaaaccgaaaccgtaaccctttaagtaacgtcttagtagttccgtagtacgtacgaaactaacgttaccgttaaggaaccgttaacgggtaccgtacctaaggttactacggttacgaggtcgagtaagcgtagtacggtagaaccttagtaaccttgacctacgtaaccacgtaacgtaacacgttacgcgtacgtacggagtacgttaacgttacgttacttacgtaaccttaacgtaaccttacgagtaacctaagtaccgttacgttaccgtaccggttaccgtaccggttacggtacccgggtaacgtaaccgggtaccgaagggtagaacgttagaccggtagtacggtaacgttacggacgtacgtaccgaacgtccttagtac

SEQ ID NO: 144264 - DNA, 659 bp, Homo sapiens
  misc_feature: GYAE6OF01E1YS9.53.27.C05.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (535)..(535): a, c, t, g, unknown or other
  misc_feature (535)..(535): n is a, c, g, or t
tcagcgcgtatacacacgaccggtgctcgattttagacgcgatcgaagggtttgggggagtcagtctcagtcaggacacagcatggacatgaggtccccgctcagctcctggggctcctgctactctggctccgagatgaccaattgtgacatccagatcgacctagtcctccactcctcctgtcagcatcgtgtagagacagngtcaccatcacgttcgccgggtacaagtcanatacagttagactaccgtaatttaactaggtatcgacgactaacgaaccgaggaacctaacgaccccttaatactttacgtacgtacttagtacgcttagacctaacgtacttacggaacgtaaggtcggtacctacgtcgtaaggttcgagtcggtacgtaggtcggaagtcgtaggactagtaacttaccgtacgtaccgtactaaccgtactaacgtaacgtagttccgacggtacgtacgtacgtacggttaaccgttagtttccgaacctacttaaccttacgtacaaccgtaanacgtttacgtacgtaccgttacgtaccgtacggttacggaaccgacgggtacgacggttacggacgtaacgtacggaaaccgtacggtacgtacggttacgacgtacgacctcggtaccttacg

SEQ ID NO: 144265 - DNA, 506 bp, Homo sapiens
  misc_feature: GYAE6OF02IFKPH.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtgggtccatcaaggttcagtggcagtggatctgggacagaattcactctcacgatcaacagtctgcaggctgacgtattttcgactaacctactactgtcaactagagttactagtttccctacggacgtttcggaccgtaagggaccacgggtggagtatacgaagcgaacgtggtggctgctaccatccg

SEQ ID NO: 144266 - DNA, 492 bp, Homo sapiens
  misc_feature: GYAE6OF02HBPWX.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtcaccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtgggtccatcaaggttcagtggcagtggatctgggacagaattcactctcacgatcaacagtctgcaggctgacgattttgctaacctactactgtcaacagagttacagtttccctcggtacgttcgccgaacggaccgacggtggagatacgaagcgaactgtggcgtgcacatcg

SEQ ID NO: 144267 - DNA, 528 bp, Homo sapiens
  misc_feature: GYAE6OF02GQ36M.53.27.C05.1.454.CMB.1.raw
  modified_base (367)..(367): a, c, t, g, unknown or other
  misc_feature (367)..(367): n is a, c, g, or t
  modified_base (432)..(432): a, c, t, g, unknown or other
  misc_feature (432)..(432): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttgccgggcaagtcagatcattggaatccatttaaattggtattcagcagaaaccaggacaagcccctaatattctgaatcttggctgcaaacactttgcaaagtggggtcccatacaaggttcagtggcaggtgatcgtggacagaatcactntcacgatacaacgactctcgcgacggctggacgtattttcgactaaaccgtactactgtaccaanagtaagttactacgtttccctacggacgttcgtacgacggaccgacggtacggagagtacaacgacgaactcggtcgtagtcgaccacgacttacg

SEQ ID NO: 144268 - DNA, 499 bp, Homo sapiens
  misc_feature: GYAE6OF02GOKON.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccagacaagccctaatattctgatcttggctgcaaacactttgactaaagtgggtacccatcaaggttcagtggcagtgatctggacagattcactctacacgatcaacagtctgcagctgacgtattttgcaacctactacttgtacaacagtagttactacgtttccgcggtacgttcgacgacggaccgacggtaggaacgatacgaagacgacgtcgtggctgctacatcg

SEQ ID NO: 144269 - DNA, 512 bp, Homo sapiens
  misc_feature: GYAE6OF02IZ114.53.27.C05.1.454.CMB.1.raw
  modified_base (399)..(399): a, c, t, g, unknown or other
  misc_feature (399)..(399): n is a, c, g, or t
  modified_base (466)..(466): a, c, t, g, unknown or other
  misc_feature (466)..(466): n is a, c, g, or t
tcagcgcgtatacacacgaccggtgctcgatttagacgcgatcgaagggtttggggagtcagtctcagtcaggacacagcatggacatgagggtccccgctcagctcctgggctcctgctactctggctccgagatgccaattgtgacatccagatgacccagtctccatcctccctgtcagcatctgtaggagacagagtcaccatcacttgccgggcaagtcagatcaattggaatccattaaattggtatcagcagaaacaggacaagcccctaatattctgatctggctgcaaacactttgcaaagtgggtccatcaaagttcagtgcagtggatctgggacagaattcgactctcacgatcaactagtctgcaggctgacgtatttgcaactanactgtcaacagagttactagtttcctcggacgttcgtaccgaaggtaccgacggtacggaacggtanacgtaagaccgtaacgtacgtacggtcgtaggtccacgtacttacg

SEQ ID NO: 144270 - DNA, 502 bp, Homo sapiens
  misc_feature: GYAE6OF02JA2S9.53.27.C05.1.454.CMB.1.raw
  modified_base (303)..(303): a, c, t, g, unknown or other
  misc_feature (303)..(303): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatctggctgcaaacnctttgcaaagtgggtccatcaagttcagtgcagtgatcgtggacagattcactctcacgatcaacagtctgcaggctgacgatttgactacctactactagtcaacagtattaactagtttccctcggtacgttcgccgtaacgggaccgacggtaggacgatacgaacgacgaacgtcggtggcgtgactaccatccg

SEQ ID NO: 144271 - DNA, 537 bp, Homo sapiens
  misc_feature: GYAE6OF02G4JSE.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatcatttaaatggtatcagcagaaaccaggacaagcccctaaatattctgatcttggctgacaaacactttgacgtaaaagtggggtcccaattaccaaaggtttcagttaggcaaggtgatcgtgggacagaattcactctcacgatcaacagtctgcaggctgtacgtattttgactaaacctactactgtacaacagtaacgttaactacgtttcccgtacggtacgttcgtaccgaacggaccgacggtacggtacgagtacgaacgacgacgtacgtcggtatcggctacatacg

SEQ ID NO: 144272 - DNA, 505 bp, Homo sapiens
  misc_feature: GYAE6OF02F3M5C.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtggggtcccatcaaggttcagtggcagtggatctgggacagaattcactctcacgatcaacagtctgcaggctgacgattttgcaacctactactgtacaacagtagttactagtttccctcggtacgttcggaccgtaacgggccgtacggtggacgatacgaagcgaacgtagtcggctgcaccgatcg

SEQ ID NO: 144273 - DNA, 507 bp, Homo sapiens
  misc_feature: GYAE6OF02IHE48.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaaattggtatcagcagaaaccaggacaagcccctaatattctgatcttggctgcaaacactttgcaaagtgggtccatcaaggttcagtggcagtggatctggggacagaattcactctcacgatcaacagtctgcaggctgacgattttgactaacctactactgtacaacagagttactagtttccctcgggacgttccggccgaagggaccacgggtggagtatcgaagcgaacgtgtacggcgtcgacaccataccg

SEQ ID NO: 144274 - DNA, 490 bp, Homo sapiens
  misc_feature: GYAE6OF02F5LBT.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtgggtcccatcaaggttcagtggcagtggatctgggacagaattcactctcacgatcaacagtctgcaggctgacgattttgcaactactactgtcaacagagttacagtttccctcggacgttcgccgtaaggaccacggtggagatcgaagacgaactgtggctgctaccatcg

SEQ ID NO: 144275 - DNA, 536 bp, Homo sapiens
  misc_feature: GYAE6OF02GTC34.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtgggtcccatcaaggttcagtggcagtggatcgtgggacagaattcactctcacgatacaacagtctgcaggctgacgtattttgcaaaccttactactgtacaacagtagttactacgttttccctcgggtaccgttaccggtccgaaggggacccacgggttacggaaggacttacgaacgtacgaacgttcggtacgggcctggtaccaccgtattccg

SEQ ID NO: 144276 - DNA, 571 bp, Homo sapiens
  misc_feature: GYAE6OF02G6NX6.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatcatttaatgtatcagcagaacaggaacaacgcccctaatacttctgatcttaggctgactaaactactttgactaaagtcgggtccagtacaggttcagtggacagtaggatcgtgggacagtacttcactctacacgatcaacatctgacgagctgacgtatttcgactaacctactacgtacgtactaacaggtacttacgtaacggtttccccgttacgggttacccgtaccggtacccggtaacgggacccggttaccgggtaggtaacggtacaacggaaccgtaacgaacgttcggtacgtcgtacgtaccgaccgttacttccgg

SEQ ID NO: 144277 - DNA, 525 bp, Homo sapiens
  misc_feature: GYAE6OF02I71W2.53.27.C05.1.454.CMB.1.raw
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (480)..(480): a, c, t, g, unknown or other
  misc_feature (480)..(480): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttgccgggcaagtcagatcattgatcatttaatgtatcagcagaacaggacaacgccctaatattctgatcttggctgacaaactactttagacaaaggtgggtacccaatcgaagttcagtggcagtgatcgtggacagtattcactcncacgntacaangtctgcaggctgactatttcgactaacctatactgtacacaagtacgttaactaccgttttcctcggtacgttcgaccgtaacggaccgtacgtacgggtgtaacncgtaaagccgtaagtcgtgggtaccgtacgtaccgacctagtacg

SEQ ID NO: 144278 - DNA, 556 bp, Homo sapiens
  misc_feature: GYAE6OF02G09AQ.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcaagaaaccaggacaagcccctaatattctgatcttggctgacaaacactttgactaaaggtggggtacccatcaaggttcagtggctaggtggatcgtgggacagtaattcacttctacacgatacaacagtactgcgaggctgacgtattttcgacctaaccttactactagtacaaactagtagttacctacgttttccctacgggtaccgtttcggaccgtaacgggtaccgacgggtacgggaagacgtacgaacgacgtaacgtcgttcgggcctaggtccacgtacttccg

SEQ ID NO: 144279 - DNA, 517 bp, Homo sapiens
  misc_feature: GYAE6OF02HB15M.53.27.C05.1.454.CMB.1.raw
  modified_base (345)..(345): a, c, t, g, unknown or other
  misc_feature (345)..(345): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttgccggcaagtcagatcattggaatccatttaaattggtatcagcagaaaccaggacaagcccctaatattctgatcttggctgcaaacactttgcaaagtgggtccatcaaggttcagtggcagtggatntgggacagaattcactctcacgatacaacagtctgcaggctgacgtattttgactaactactactgtacaactagagttaactacgttttaccctcggtaccgttcggtaccgaacgggtaccgacggtaggagacgtacgaagacgtaacgtcgtacggctgcaccatacg

SEQ ID NO: 144280 - DNA, 507 bp, Homo sapiens
  misc_feature: GYAE6OF02GR4EN.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtggggtcccatcaaggttcagtggcagtggatctgggacagaattcactctcacgatcaacagtctgcaggctgacgtatttgcaacctactactgtacaacagtagttactacgtttcccgtcggtaccgttcgaccgtaacgggaccacggtcggagactacgaagacgaagtcgtcggctcgcaccatcg

SEQ ID NO: 144281 - DNA, 516 bp, Homo sapiens
  misc_feature: GYAE6OF02FWVP3.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtaatcagcagaaaccaggacaagcccctaatattctgatcttggctgcaaacactttgcaaagtggggtcccatcaagttcagtggcagtgatctgggacagaattcactctcacgatcaaacagtctgcaggctgacgattttgcaacctactactgtaccaacgagtagttactacgtttcccgtcggtacgttcggaccgaagggaccgacgggtaggacggactacgaacgtacgaacgtgtcggctgacgacctatccg

SEQ ID NO: 144282 - DNA, 507 bp, Homo sapiens
  misc_feature: GYAE6OF02F8W60.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccattaaattggtatcagcagaaaccaggacaagcccctaatattctgatcttggctgcaaacactttgcaaagtgggtcccatcaagttcagtggcagtgatcgtggacagaatttcactctacacgatacaacagtctgcaggtctgacgtattttgacctaacctaactactgtacaactagagttactacgtttccctcggaccgttcgacgaacggaccgacggtacggagactcgaagcgaacgtgtcggctgctacattcg

SEQ ID NO: 144283 - DNA, 560 bp, Homo sapiens
  misc_feature: GYAE6OF02GTOHR.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcaagaaaccaggacaacgacccctaatacttctagattcttggctgacaaactactttgactaaaggtcgggtacccagtacgaaggttcaggtggacaggtggatcgtagggacagtaatttcacgttctacacgactacaaactagtctagacaggctagacgtattttgacctaacctactactcgtacaacgtagtaacgttactacgtttccgtacggtacgttacggaccgtacggaccgacggtaggaacgtacgtacgaagtacgacgtacggtcggtactcgactacattacg

SEQ ID NO: 144284 - DNA, 553 bp, Homo sapiens
  misc_feature: GYAE6OF02GWFX5.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaatggtatcagcagaaaccaggacaagcccctaatattctgatcttggctgcaaactactttgacaaagtcgggtcccatcaaggttcagtggcagtggtatctgggacaggtaacttcacctctacgacgtactacaactacgtctgcaggctagacgtattttcgacctaacctactactcgtacaactagtactttacgtacgtttccctacggtaccgttacggaccgaacgggtaccgacggtacggtacggaacgtcgaaacgacggtaacgtaggtcggacgtcggtactaccgattccg

SEQ ID NO: 144285 - DNA, 507 bp, Homo sapiens
  misc_feature: GYAE6OF02H6LSD.53.27.C05.1.454.CMB.1.raw
  modified_base (302)..(302): a, c, t, g, unknown or other
  misc_feature (302)..(302): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaatggtatcagcagaaccaggacaagcccctaatattctgatcttggctgcaaacnctttgacaaagtgggtccatcaagttcagtggcagtgatcgtggacagattcactctacacgatacaacagtctgcaggctgacgtatttgctaacctactactgtacaaacagagttactagtttccctcggtacgttcggacgaacggaccgacggtcggaagtactacgaagacgtaacgtgtcggcgtgaccaccattccg

SEQ ID NO: 144286 - DNA, 521 bp, Homo sapiens
  misc_feature: GYAE6OF02FLR8D.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtgggtcccatcaaggttcagtggcagtgatcgtgggacagaattcactctcacgatacaacagtctgcaggctgacgatttgcaacctactactgtcaacagtagttacacgtttcccgtcggtacgttccggacctaacgggaccgtacggtacggaaggtacgtacgaagtcgaacgtggtacggtccgtacgctaccgattccg

SEQ ID NO: 144287 - DNA, 547 bp, Homo sapiens
  misc_feature: GYAE6OF02FGOBI.53.27.C05.1.454.CMB.1.raw
  modified_base (220)..(220): a, c, t, g, unknown or other
  misc_feature (220)..(220): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctcctgtcagcatctgtaggagacagagtcaccatcacttgccgggnaagtcagatcattggatccatttaattgatcagcagaaaccaggacaacgaccctaatattctgtatcttggctgacaaactcttagacaagtcggggtaccatcgaaggttcaggtgcgagtggatcgtagggacaggtaattcactctacgaacatacaactagtctgacaggctagtacgtatttgactaacctactacttgtacaacgagttaacgttactacgtttcccgtacggtaccgttcgtaccgaacgggtaccgacggtggtaacgacgtacgaacggtacgtaacgtacggtcggacgtcgaccgacgtacttcg

SEQ ID NO: 144288 - DNA, 555 bp, Homo sapiens
  misc_feature: GYAE6OF02F7B9T.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacactttgcaaagtgggtcccatcaaggttcagtggcagtggatctgggacagaattcactctcacgatcaacagtctgcaggctgacgtattttgactaaccttactactgtacaaacgtagtacgtttaacctacgttttccctacggtaccgttccgggacccgtaacgggtaccgaacgggtacgggaacgtacgtacgaacggtaccgaaacgttcggtacggtccgttacggacctaccgtattaccg

SEQ ID NO: 144289 - DNA, 720 bp, Homo sapiens
  misc_feature: GYAE6OF02IR5O5.53.27.C05.1.454.CMB.1.raw
  modified_base (197)..(197): a, c, t, g, unknown or other
  misc_feature (197)..(197): n is a, c, g, or t
tcagcgcgtatacacacgaccggtgctcgatttagacgcgatcgaagggtttgggggagtcagtctcagtcaggacacagcatggacatgagggtccccgctcagctcctgggctcctgctactctggctccgagatgccaattgtgacatccagatgacccagtctccatccctccctgtcagcatcgtgtagganacagagtcacctatcacttggccgggcaaagtcagatcattgaatcattaataggtatcagcagaaaccagacaacgaccctaatattctagtatacttcggctcgacaaactactttagactaaaggtcggggtacccaagtacctaaaggtttacacggttaggactaggtacggtaagtcgtacgggggaactaaggtaaactttccgtaactaccgtaccgtaaccggtaaattaccgtaaacgtacggttacctaggaccgtaagggtcttaacgggtaaaccgtttacgtttttacggacccttaaaccgtttacttaaccgtacgttaaccgaaacgttaacggtaaaccgttttaaccgtaaccggttttaccccgttaacggggtaccggtttaaccggtacccgggtaaacgggtacccggttaacgggtacgggtaacggtaacgtaccggtaaacgtacccggtaacgttacggtcggtacgtaccggtaccgtaaccgttcgttaaccgg

SEQ ID NO: 144290 - DNA, 551 bp, Homo sapiens
  misc_feature: GYAE6OF02HPNEY.53.27.C05.1.454.CMB.1.raw
  modified_base (221)..(221): a, c, t, g, unknown or other
  misc_feature (221)..(221): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggnaagtcagatcattggaatcctatttaaattggtatcagcaagaaaccaggacaagcccctaatattctgatcttggctgacaaactactttgactaaaggtcgggtacccagtcaaggttcagtggactagtggatcgtagggacagtaattcactctacacgatacaaactgtctgcgaggctagacgtatttcgactaacctactactacgtacaacagtacgttacgtacgtttcccgtacggtaccgttaccggaccgaacgggtaccacgggtacggaaggactacgaagtaccgaagtcggtacggacgtcgactaccgattcg

SEQ ID NO: 144291 - DNA, 549 bp, Homo sapiens
  misc_feature: GYAE6OF02JBNWG.53.27.C05.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtcctccatcctccctgtcagcatctgtagganacagagtcaccatcacttggccggcaagtcagatcatgatcattaattgtatnagcagaaacagacaacgaccctaatattctagatctggctgacaaactactttgacgaaaggtcgggtaccatacgaagttcgagtggcaggtgatcgtaggacagtaatcactctcacgatcaactgtctgcacggctacgtaacgttattttacgacctaaccttaccgtactacgtacctaacagtacgttactacgtttacccgtcggtacggttaccgaccgaacggtaccgtaccgggtaggtaaggactacggacgacgtaaccgtagtcgggctacggctaccgtactcgg

SEQ ID NO: 144292 - DNA, 531 bp, Homo sapiens
  misc_feature: GYAE6OF02GBS32.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatatctgatcttggctgcaaactactttgacaaagtgggtacccatcaaggttcagtgcagtggatctgggacaggtaattcacttctacacgataccaacagtctgacaggactagtacgtattttcgacctaacctactactcgtacaacagtaacgttactacgttttacccgtcggtacgttcggaccgaacgggaccgacggtaggacgagtacgaagacgacgtggtcggcgtcgacaccattcg

SEQ ID NO: 144293 - DNA, 499 bp, Homo sapiens
  misc_feature: GYAE6OF02HV10V.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccagacaagcccctaatattctgatcttggctgcaaacactttgcaaagtgggtcccatcaaggttcagtggcagtggatcgtgggacagaattcactctcacgatcaacagtctgcaggctgacgtattttgctaacctactactgtcaacagagttacagtttccctcggtacgttcggccgaagggaccgacggtggagatcgaacgcgaacgtgtcggcgtgcaccatccg

SEQ ID NO: 144294 - DNA, 555 bp, Homo sapiens
  misc_feature: GYAE6OF02HNKAV.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagacccctaatattctgatcttggctgcaaactactttgacaaaggtgggtcccatacaaggttcagtggcagtggatcgtgggacagaattcactctacacgatacaacagtctgcaggctaggacgtattttcgacctaacctactacttagtacaactagagtttaactacgttttcccgtacggtaccggttccggaccgtaacgggaccgacgggttagggaacgacgtacgaacggtaccggaacgttggtacggcctcggtaccgaccgtattccg

SEQ ID NO: 144295 - DNA, 535 bp, Homo sapiens
  misc_feature: GYAE6OF02I5PI0.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggaacaagcccctaatattctgatcttgctgcaaacactttgctaagtgggtcccatcaagttcagtggcagtggatcgtgggacagaagttcactctcacgatacaacagtctagcgaggcgtagacgttatttcgacctaactactactagtacaacagtattaacgtacgtttccgtacggtacgttaccggaccgaacggtaccgacgggtacggagtacgtacgaacgtacgtacgtggcggtacgtagacccactacttacg

SEQ ID NO: 144296 - DNA, 672 bp, Homo sapiens
  misc_feature: GYAE6OF02H6DC6.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtcctccatccctcctgtcagcatctggtaggagacagatcaaccatcacgttcggccgggacaagtcagatcattgactacctaatttaaattggtatcagacaagaaaccaggaacaacgtacccctaattattcgtgtacttcgttcggactagacctaaactacgtttagacgtaaaggttcgggtacctagttaccgtaacggtttcgaggtgacgtaggtacggtagtcggtaggactaagtaacttctactctactacgtacttacaacgtacgttcgtacgacgtacgggtctagtacgttacgtttacgacctaaccttacttaccgtagtaccgaaacgtacgtaacgtttaccgttaccgttttacccgtaaccgggtaccgtttacccgggtacggtaaccgggtaccggtaacgggtaggtaacgtaacgttaacggaaccgtaccggtaacgtcgggttacggtacccgtacgtacctacccggtattcccgg

SEQ ID NO: 144297 - DNA, 627 bp, Homo sapiens
  misc_feature: GYAE6OF02GVT2U.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttggccgggcaagtcagatcattggaatacctaattttaaattggtatcagacaagaaaccaggacaacgtacccctaatattctagtacttcgttggctgacaaactactttacgacgtaaaggtcgggtacccagtacgaaggtttcaggtggacgaggtggatcgtagggactaagtaactttcacttcctacacgtactacaaacgtagttacctgacgcggtacttaggaacgttattttcgactaaccttactactacgtacaaactagtaacgttaccttacgttacccgttaggtaccgttaccggaccggtaaacggacccgtaacgggtacgggtaacgtaacgttaacggaacgtacggtaacgttcggtacggtcgttaccggtacctaccgtattacccgg

SEQ ID NO: 144298 - DNA, 573 bp, Homo sapiens
  misc_feature: GYAE6OF02HOT8K.53.27.C05.1.454.CMB.1.raw
  modified_base (555)..(555): a, c, t, g, unknown or other
  misc_feature (555)..(555): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctcctgtcagcatctgtaggagacagagtcaccatcacttgccgggcaagtcagatcattggaatctatttaatggtatcagcagaaccagacaacgaccctaatacttctagattcttgctgactaaactacttagacgtaaacggtcgggtacccagttacgtaaggtttcgagttaggctaggtggtatcgtagggactagtaactttcactctacacgtaactcaaactagtctcgacgtagcgtacgacgttatttcgacctaacttacctactacgtacaacgtactacgttactacgtttcccgtacggtaccgttcggaccgtaacgggtaccgtacggtaggaacgacgtacgaacgtcgaacgttgacggtntacgacgtacctgttacg

SEQ ID NO: 144299 - DNA, 522 bp, Homo sapiens
  misc_feature: GYAE6OF02JDYZ7.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaacgcccctaatattctgatcttggctgacaaactactttgcaaagtgggtaccatcaaggttcagtggcagtggatcgtgggacagattcactctacacgatcaacagtctgcagctgacgtatttcgacctaacctactactcgtacaacagtacgtactacgtttcccgtaggtaccgttcgaccgaacgggtaccgacggtcggaagactacgaagacgtacgtggtcggcgtcgacaccgtattcg

SEQ ID NO: 144300 - DNA, 547 bp, Homo sapiens
  misc_feature: GYAE6OF02FWE5F.53.27.C05.1.454.CMB.1.raw
  modified_base (221)..(221): a, c, t, g, unknown or other
  misc_feature (221)..(221): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggnaagtcagatcattggaatccatttaaattggtatcagcagaaaccaggacaagcccctaatacttctgatcttggctgacaaactactttgacaaaggtcggggtcccatacgaaggttcagtggcagtggatcgtgggacagtaattcactctcacgatcaacagtctgcaggctagacgtattttcgacctaacctactactcgtacaacgtacgtagttacgtacgtttacccgtcggtacgttccggaccgtaacgggtaccgacgggtacggaacggacgtacgaacgacgaacgtggtcggtcgtagaccacctgtaccg

SEQ ID NO: 144301 - DNA, 535 bp, Homo sapiens
  misc_feature: GYAE6OF02FV0D3.53.27.C05.1.454.CMB.1.raw
  modified_base (221)..(221): a, c, t, g, unknown or other
  misc_feature (221)..(221): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (530)..(530): a, c, t, g, unknown or other
  misc_feature (530)..(530): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggnaagtcagatcattggaatcctatttaaattggtatcagcagaaaccaggacaacgccctaatattctgatcgttggctgactaaactactttagactaaaggtcgggtaccatacgtaaggttcaggtggcagtggatcgaggacagtaatcatctacacatcaantctgacnggactgacgtatttgaccaactactactagtaccaacgagtagttacgtacgtttacccaggtacgttcgaccgaacgggaccgtcgggtaggacgtagtacgaacgtacgaacgtgtacggactacggactaccntaccg

SEQ ID NO: 144302 - DNA, 650 bp, Homo sapiens
  misc_feature: GYAE6OF02I8BEJ.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctgggctcctgctactctggctccgagatgccaattgtgacatccagatgacccagtcctccatccctccctgtcagcatctgtaggagacagagtcaccatccacgttcggccggcaagtcagatcatgaatctatttaatggtatcgagcaagaacaggaacaacgccctaatatctagtactctggctcgactaaactctttacgacgtaaacggtcgggtaccaagtacgtaaggtttcgaggttcggacgtaaggtacggtactacgtacgggataacggtacttacgtacttcgtacaacgtactaaccgtaactacggttctaggacgtacggtcgtacgtaacgttactttacgacctaacttactacgttagtaacgaacgtacgtaacgttaaccgtaccgttttcccggtaaccggttacggtaaccggtaccgtaaacgggtaccggtaccgggtaaggtacgtaaccgtaacgtaacggtacggtaacggtacggttcggaccgttacgtaccgtaccgtagttaccgg

SEQ ID NO: 144303 - DNA, 636 bp, Homo sapiens
  misc_feature: GYAE6OF02JI6E3.53.27.C05.1.454.CMB.1.raw
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
tcagcgcgtatacacacgaccggtgctcgatttagacgcgatcgaagggtttgggggtaggtcgagtctcagtcaggacacagcatggacatgagggtccccgctcagctcctgggctcctgctactctggctccgagatgccaattgtgacatccagatgacccagtctaccatccctccctgtcacgccatcctgtaggacacagagtccaccatcactggcccggnaagtcagatcattgatctattaatgtancancagaacagacaacgaccctaatnttcnatactgctnacaanacttgacaagtgggacccagtctaacggttcagtggaccaggtgatcgtagggactaaggattcacgtactccgaacgtacactaaccgtagtacctagacgtacggtacgtacgtaacggtattttacggacctaaccgttaacctacgttaacgtaaccgaaactacggtaaacgtttacgtaccgtttttacccgtaccggttaaccggttaacggtacccgtaacgggtacccggttaaccggtacgggtaacgttaacgtccggtaaacgtacggtaaccgttaacgggttacccggcgttacccgaaccgttaccctaccggttacccg

SEQ ID NO: 144304 - DNA, 599 bp, Homo sapiens
  misc_feature: GYAE6OF02FF6JI.53.27.C05.1.454.CMB.1.raw
  modified_base (221)..(221): a, c, t, g, unknown or other
  misc_feature (221)..(221): n is a, c, g, or t
  modified_base (485)..(485): a, c, t, g, unknown or other
  misc_feature (485)..(485): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggnaagtcagatcattggaatcctatttaaattggtattcagtcagaaaccaggacaacgcccctaatatctgatctggctgctaaactactttgacgtaaaagtcggggtacccagtactaacggttcaggttggactaggtggtatcgtgggtacaagtattcactcgtcaccgatacaactagtctgcaggctagtacgtattttcgacctaaccgttacctactagtaccaacgtagtaacgtttaactacggtttttacccncggttaaccgttccggtaacccgaacgggtacccgtaacgggtcgggaacgtaacgtaccgtaacggtaccgtaacgtcggttacggtaccgtacggcctaaccgtattacccg

SEQ ID NO: 144305 - DNA, 538 bp, Homo sapiens
  misc_feature: GYAE6OF02G1VJE.53.27.C05.1.454.CMB.1.raw
  modified_base (304)..(304): a, c, t, g, unknown or other
  misc_feature (304)..(304): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgcaaacnctttgcaaagtggggtcccatcaaggttcagtggcagtggatcgtagggacaggaattcactctacacgatacaactagtctgcaggcctaggacgtattttgacctaacctactactgtaccaactagattactacgtttccctcggtacgttccggtaccgaacgggacccgacgggtacggaaggactacgaaggacgtaacgtcggtcggcgtcggactaccgattaccg

SEQ ID NO: 144306 - DNA, 546 bp, Homo sapiens
  misc_feature: GYAE6OF02G1UM9.53.27.C05.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtagganacagagtcaccatcacttgccggnaagtcagatcatgatcatttaatgtatcagacagaaccagacaacgaccctaatattctagtatcttggctcgacaaactactttgactaaaggtcgggtacccagtacgaaggttcaggtggctaggtggtatcgaggacagtactcactctacacgatacaactagtctagcgaggctagtacgtatttacgactaacctactactactacaactagtacgttacttacgtttcccgtacggtaccgtcgaccgtacggaccgtagggtacggaagtaactacgaacgtacgtacgtacggtcgacgtacgcctacgtactacg

SEQ ID NO: 144307 - DNA, 581 bp, Homo sapiens
  misc_feature: GYAE6OF02IVTV0.53.27.C05.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtagganacagagtcaccatcacttgccggnaagtcagatcatgatccattaaattggtatcagcaagaaaccaggaacaacgacccctaatattctagatcttggctgacaaactactttagactaaaggtcgggtaccctagtacgtaaggttcagtggactaggtggaatcgtagggaactaggtaacttcactcctacaacgtatacaaacacgttctagacaggtctaggtacgtattttcgactaacctactacttcgtactaactagtaacttactacgtttacccgtacggtaccgttccggaccgtaacgggtaccgacggtacggacgtaagtacgaacgtacggtaacgttcggtacggtcgtacgacctacgtactaccg

SEQ ID NO: 144308 - DNA, 737 bp, Homo sapiens
  misc_feature: GYAE6OF02GCL3K.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggacaagtcagatcattggaatccatttaaattggtatcagcagaaaccaggacaacgacccctaatattctagacttcttaggcttgactaaactactttgacgtaaaggttcggggtaccctagttaccgtaacggtttcgaaggttcggacgtagggttggtaagtccgtaggggaacctaaggtaaactttcaaccgttccgtacgtaaccggtactaccgtaaacgtacgttaccgtacggtacgtacgggtaccgttacggttaaccgtaacgtttttacgaacccttaaacccgttacctttaaccgttacggttacctaaacgtaacgttaacgttttaaccgttaaccggttttacccccgttacgggttacccggtttaccgggtacccggtaacggggtacccggtaacgggttacggggtaacggttaacgtaaccggtaaacggtaccggttaaaccggttcggtaccgggtaccgttaccgggaccgtacccgtacgtttaccgg

SEQ ID NO: 144309 - DNA, 560 bp, Homo sapiens
  misc_feature: GYAE6OF02IXZCO.53.27.C05.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtagganacagagtcaccatcacttgccgggnaagtcagatcattggaatccatttaatgtatcagcagaaaccaggacaagcccctaatattctgatcttggctagacaaactactttagactaaaggtcgggtacccagtacgtaaggttcaggtcggacaggtggatcgtgggaacagtaatttcgacttctacacgtatactaacagtactgacgaggctagacgtatttcgactaacctactactgtactaactagtacgttactacgtttacccgtcggtaccgttccggaccgtaacggtaccgacgggtcggaagtacgtacgaacgacgtaacgtcggtcggacctcggactaccgtatccg

SEQ ID NO: 144310 - DNA, 548 bp, Homo sapiens
  misc_feature: GYAE6OF02GXN2T.53.27.C05.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtagganacagagtcaccatcacttggccgggnaagtcagatcattggaatccatttaaattggtatcagcaagaaaccaggacaacgcccctaatattctagatcttggctgactaaactactttagactaaaggtcgggtacctatacgaaggttcagtggcaggtggatgtagggacaagtactcactctacgacgatcaactcgtctgcgagtctagtacgttatttcgacctaactactactgtacaactagtacgttacgtacgtttcccgtggtaccgttcgacgtaacgggtaccgacggtacggagtacgtacgaacgtacgtacgtggtcgcttacggactactattcg

SEQ ID NO: 144311 - DNA, 593 bp, Homo sapiens
  misc_feature: GYAE6OF02IHN81.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagatcaccatcacttgccgggcaagtcagatcattggaatccatttaaattggtatcagcagaaacaggacaagcccctaatattctgatctgctgacaaacacttagacgtaagtcgggtaccatcaaggttcaggtgacagtaggtatcgtagggactagaattcgactctacgacgactacaaacacgttcgtagcgacggtactggtaacgttagttttcgacctaaacccttactaaccttcgtaaccaacgtagtaacgtttaacgtacgtttacccgtaccggtacggtttacgaccgtaacgggacccgtagggtacggaacggaactacggtaacgtaccgtaacgttcggtacgggtccgttacggactacccgtagttacccgg

SEQ ID NO: 144312 - DNA, 687 bp, Homo sapiens
  misc_feature: GYAE6OF02IPK8L.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcacatcacttgccggcaagtcagatcattgatctattaattggtatcagcagaaacaggacaacgacccctaatattctgactctggtctgactaaactactttgacgtaaagtcggggtaccctaagttaccgtaaagggtttaccgtaaggttacggtacgtacggttacgggtattaccggttaggggaaaccgtaagtaaacgttttacgtaaccgttaccttaccgtaaaccggtaacttaaccgtaaaccgtaacggttccgtacggaccgaacgggtccttaggtaaccgttagtttttaccgaccttaaacccgttacctaacgttcgtaacctaaacgtagtttaccgtttaaacgttaccgttttaccccgtacgggtaaccggttccggaaccgtaaccgggtaccggtacggtacggaagtaccgtacgaacggacgtaacggtcggttcggagtccggactaccgtagtcg

SEQ ID NO: 144313 - DNA, 647 bp, Homo sapiens
  misc_feature: GYAE6OF02IY3G2.53.27.C05.1.454.CMB.1.raw
  modified_base (200)..(200): a, c, t, g, unknown or other
  misc_feature (200)..(200): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctcatcctcctgtcagcatctgtaaggagacagngtcaccatcacttggccggactaagtcagatcattggaactacctaatttaattggtatcagtcaagaaaccgaggtaacaacgtacccctaaatacttctagtatcttggacctagtaaccaaactctttagacgtaaacggtcgggtaccctaagtacgtaaggttcgaagtcggacgtaggtggagtcgtacggaacgtagtaacgtcacgttactacgaacgtactaacctaactagtacgtagaccggtaggtactggttaaacgtagttttacggacctaaaccgtacctagtaccgtataaaccgacgttaacgttaccgttacgtttaccgaacggttccggttaacgaccgtaacggtccggtaacggtacggtaactaacggtacgtaacggtaaccgtagttacggtcggtacgttccgaacgtaccgagttaccg

SEQ ID NO: 144314 - DNA, 614 bp, Homo sapiens
  misc_feature: GYAE6OF02I7OCU.53.27.C05.1.454.CMB.1.raw
  modified_base (453)..(453): a, c, t, g, unknown or other
  misc_feature (453)..(453): n is a, c, g, or t
  modified_base (598)..(598): a, c, t, g, unknown or other
  misc_feature (598)..(598): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctcctgtcagcatctggtaggagacagagtcaccatcacgttgccgggcaagtcagatcagttgaatcctatttaaattggtatcagcaagaaaccaggacaacgacccctaattacttactagattcgttaggctagacaaacctactttcgacgtaaacggttcggggtcccctaagtacgtaaggtttaccaaggttaggacgtaggttggtaagtcggtagggaacaagtaacgttacaccttactacgaacgatacaacgtagtctgcgacggtntcgtacgtattttcgactaaccctactacgttacgtacaactaggtacgttaacgtacgtttacccgtacggtaccgttaccggacgtaaccgggtaccgagggtacggacggtacgtacgaacgtacgtaacgttggtcggtcncggacctactacgtcg

SEQ ID NO: 144315 - DNA, 660 bp, Homo sapiens
  misc_feature: GYAE6OF02IC20O.53.27.C05.1.454.CMB.1.raw
  modified_base (101)..(101): a, c, t, g, unknown or other
  misc_feature (101)..(101): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (536)..(536): a, c, t, g, unknown or other
  misc_feature (536)..(536): n is a, c, g, or t
tcagcgcgtatacacacgaccggtgctcgatttagacgcgatcgaagggtttgggggagtcagtctcagtcaggacacagcatggacatgagggtccccgntcagctcctggggctcctgctactctggctccgagatgccaattgtgacatccagatgacccagtctccatccctccctgtcagccatctgtaggagacagagtcaaccatcacgttgaccgganaagtcagatnattgaatcctaatttaaagttgtatcagacaagaaccaggaacaacgacccctaattacttctagattcgttggctacgacgtaaaactacttttaggaacgtaaggtcggggtaccctatacgtaacgggttctaaggttgacgtaagtgggacttcgtagggaactaggtaactttccgtactacgtccgaacgtactacaaccgtagttccgtaggacgtacggtcgtaggtaccgttatttacgacccgttaaacctactaccgtagttaaccaaagttacgtaacgtttaacccncggttttacccgtcggtaccgttaccggaccggaacggtacccggtacgggtacggaacgtaacgtaccgtaacggaccggttaaccttgggtacggtaccgtaccgacgtaccctagttaccg

SEQ ID NO: 144316 - DNA, 651 bp, Homo sapiens
  misc_feature: GYAE6OF02HUCFW.53.27.C05.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatcngtagganacagagtcaaccatcacttggaccgganaagtcagatcattagaatctaatttaaattggtatcagactaagaaaccaggaacaacgacccctaattattctagattcgttgctagactaaaactccgtttagacgtaaaaggtcggggtaccctatacgtaagttcaggtgcgtaagtagatcgtaggacaagtattacactactacacgaactacaaacgtgtactagcacgggtctaggtaacttattttacgaacctaaccgtaacttacgtacgtaacctaaacgtacggtaacttaaccgttacggtttaccccgttacgggtaaccggtttccggaacccggtaagggtaacccggtacgggtaacggtaaccggtaacgtaccgtaaaggtaacccggtaacgttacggtcggtaccggttacgaaccgtacccgtatttacccgg

SEQ ID NO: 144317 - DNA, 701 bp, Homo sapiens
  misc_feature: GYAE6OF02IUYBU.53.27.C05.1.454.CMB.1.raw
  modified_base (101)..(101): a, c, t, g, unknown or other
  misc_feature (101)..(101): n is a, c, g, or t
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagcgcgtatacacacgaccggtgctcgatttagacgcgatcgaagggtttgggggagtcagtctcagtcaggacacagcatggacatgagggtccccgntcagctcctgggctcctgctactctggctccgagatgccaattgtgacatccagatcgacccagtctccatcctcctgtcagcatctgtagganacagatcaccatcacgttggccgggntaacggtcagatcacttaggatcctatttaatggtatcagtcaacgtaaaccgaggaccaacgtacccctaagttacttctgtaacgttcgttaggacctgtaacctaaacgttacgtttagaacgttaaacggttcggggtaccctagttaccgtaaacggtttcgaacggttacggtacgtaacggttcgaaacggtttcggttaacggggaactaagttaaaccgtttacccgtaacccgtttaccggtaacccgtaaacggttaaccgtaacccgtaaaccgttaacggttaccgtacggtaccgtacgggtacgttacggtaaacgtttacgtttacgaacccttaaccgtacttacgacgttaacaccgtaagttacgttacgtaacgtttcccgtacgtacggttccgaaccgtacggtacgaggtacgagaactcgtaacgccgtaacgtgtcggtcactacgcctagttcg

SEQ ID NO: 144318 - DNA, 528 bp, Homo sapiens
  misc_feature: GYAE6OF02GPPDQ.53.27.C05.1.454.CMB.1.raw
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (360)..(360): a, c, t, g, unknown or other
  misc_feature (360)..(360): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (495)..(495): a, c, t, g, unknown or other
  misc_feature (495)..(495): n is a, c, g, or t
tcagcgcgtatacacacgaccggtgctcgatttagacgcgatcgaagggtttgggggagtcagtctcagtcaggacacagcatggacatgagggtccccgctcagctccgtgggctcctgctactctggctccgagatgccaattgtgacatccagatgacccagtctccatccctcccgtgtcagcatctgtaggagacagagtcaccatcacgttgccggnaagcagatcatgaatcctaatttaaatcgtatcagcaagaaacngaacaacgaccctaatntctgatcgtgctgactaatacgttgacgtaaagcgggtaccagtacgtaaggtcaaggtgactaaggtgactacgnggtaacagtaactcgtactctacgacgatacacgtaatcacgctagcttgacgttattcgaacctaactntaccgtnagaacaggtactcgttacgtccgagtacgttcgacgaacgcgtacgacggatacgtanaacgtagacgtaggtcgactcgtacgactatcg

SEQ ID NO: 144319 - DNA, 561 bp, Homo sapiens
  misc_feature: GYAE6OF02GELYV.53.27.C05.1.454.CMB.1.raw
  modified_base (558)..(558): a, c, t, g, unknown or other
  misc_feature (558)..(558): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctcctgtcagcatctggtaggagacagagtcaccatcacgttcggccgggcaagtcagatctattaggaatacctaatttaaattggtatcagacaagaaaccaggaacaacgaccctaaatattctagtatcttggctgactaaactactttagacgtaaaggtcgggtaccagtaccgaaggttcaggtggacgaggtgatcggtaggacaggtatctactctacacgataccaacgtacgtacgacgccgacgtcgtagtaacgtatttacgaacttacctactatcgtacaacgtagtacgttacttacgttccgacgtcggtcgacgacggaccgtaggtacggacgatacgacgtacgtacgtgtcgcgtgctacgtntcg

SEQ ID NO: 144320 - DNA, 705 bp, Homo sapiens
  misc_feature: GYAE6OF02H3X4M.53.27.C05.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctcctgtacagccatctgtagganacagacgtcaccatctacgttggccggganaagtcagactcgaagttgaactactaagtttaaaatggtatcagacaagaaaccgaggaacaacgtacccctaaatattctagattctggctacgactaaactacttagacgtaaaggtcgggtaccagtacgtaaagtcaaggtcgacgtaggtagtagtacgttgggaaactaggtaactttcgaactcgtacgacgaacttacgaacgtagttcgagtaccgtaggtacctaggttaacgttacgttttacgaacctaaacgttaacctaacgttaacgtaaccgtaaacggtaaacgttaacgtttaaaccggtttacccgttttaccccggtacgggtacccgtttaacggggacccgtaaaacggggtacccggtaacgggttaacgggtaaacggaaccgtacggtaaaaccggtacggtaaacgttcgggtaaccggttaccgtacggtacgtaaccctagttaacccgg

SEQ ID NO: 144321 - DNA, 740 bp, Homo sapiens
  misc_feature: GYAE6OF02IQ0SJ.53.27.C05.1.454.CMB.1.raw
  modified_base (222)..(222): a, c, t, g, unknown or other
  misc_feature (222)..(222): n is a, c, g, or t
tcagcgcgtatacacacgaccggtgctcgatttagacgcgatcgaagggtttgggggaggtcagtctcagtcaggacacagcatggacatgagggtccccgctcagctcctgggctcctgctactctggctccgagatgccaattgtgacatccagatgacccagtctccatccctccctgtcagcatctgtacggagacagagtcacatcacttgccgganaagtcagactcattggactacctaatttaaattaggtatacagtacaacgaaaccaggaacaacgtacccctaaagtacttactagtaacttcgttagggtacctgtaaccaaaacgttaaccgttttgaaccggttaaaagggtccggggttacccaacttaaccgtaaacgggtttccgtaaaggttgggaaccgtaggtacggtaacgtcggttaacggggtaactaaggtaaactttccgtaaccgttaacctaccgtaaacgtaactaacccgtaaacgtaacgttacgtacgtacgtaacggtctacggtaaccgttattttacgaccgtaaacttacctacttagaacctaaagttacggtaactttaaccgttaccgttttacccgtacgggtaaccgttaccgggttaccgtaaccggggacccgttacgggtacggtaacggtaaccgtacggtaacggaacgtacggtacggtttacggaccgttacggacttaccgtaccgttacg

SEQ ID NO: 144322 - DNA, 627 bp, Homo sapiens
  misc_feature: GYAE6OF02GBP5G.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcccgctactctggctccgagatgccaattgtgacatccagatgacccagtctccatcctccctgtcagcatctgtaggagacagagtcaccatcacgttgccgggcaagtcagatcattggatccatttaatgtatcagcagaacaggacaagccctaatattctgactcttggctgactaaactactttgacgtaaagtcggggtaccagtactaaggttcaaggtcggacgagtacggatcggtagggacctaagaactaccgtactccgtactaacgactaacgaactacgtacgttgtaacgacggtcgtagacgttacgttttacgaacctaacctaacttaaccgttacgtaacctaacgaagtacgttaaccgttaacgttttcccgtacggtaccggttccggtaacccgtaagggtacccgaacgggtagggtaaccggtaacgtaccgaacggtaccgtaacgtaggtacggttcgaccgtaccgacctacgtcttaccgg

SEQ ID NO: 144323 - DNA, 603 bp, Homo sapiens
  misc_feature: GYAE6OF02GVSP3.53.27.C05.1.454.CMB.1.raw
tcagcgcgtatacacacgaccggtgctcgatttagacgcgatcgaaggggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttggccgggcaagtcagatcattggaatccaatttaaatggtatcagcaagaaaccaggacaacgacccctaatattctgactcttggctcgactaaactactttgacaaaggttcggggtaccatacgaaggttcaggtcggacgaggtaggatcgtagggacagtaatttcgacctctaccaacgtaataccaaacacgtactacggacgtaggactggtaacgttacgttttacgacctaaaccttactactacgtacgaactacgtaacgttaacgtacgtttacccgtacgggtaccgttaccggaccggaacggacccgtacgggtaggacggtaactaacggtacggacgtaacgtggtacggacgtacgactaccgtattcg

SEQ ID NO: 144324 - DNA, 771 bp, Homo sapiens
  misc_feature: GYAE6OF02JNR17.53.27.C05.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
tcagcgcgtatacacacgaccggtgctcgatttagacgcgatcgaagggtttgggggagtcagtctcagtcaggacacagcatggacatgagggtccccgcgtcagctcctgggctcctgctactctggctccgagatgccattgtgacatccagatgacccagtctccatcctccctgtcagcatctgtagngacagngtccacatcacttcggcccgggtcaagtcgagatcagttggaatacctaatttaaagttggtactcagacaacgaaaccaggactaacgaccccttaattacttctacgtattacgttaggtctacgtacaaccttactttacgtaacgtaaacggtcgggtaccctaagtacgtaaacggtttacgaggtacggtactaggtagacgttcgtagggacgaagtagtcacctacgtacgacgtactacgaaaacgttcgttacgacggtaccgagggtacgttaacggtaacgtttaccggttttacggaacccctttaaaccgttaacctttaccgttaacggtaacccgttaaaccgtaaacgggtttaccggttttaaaccccgttacccgggtttttaccccggtaacccgggttaaccggttcccggggtaacccggtaacccggggttacccggtaaccggttacggggtaaaacgggtacctaaacggggttaacccggtaaccgttaaccgggtaccggttaccggtaccggtaccggtaccctaccgttacccgtttacccgg

SEQ ID NO: 144325 - DNA, 702 bp, Homo sapiens
  misc_feature: GYAE6OF02IS724.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttggcccgggacaaggtcagatacattaggaatacctaattttaaaagttggttaatacgagacaagaaaccaggaacaaaccgacccctaagtatttctagtacttcgtggtcttagacctaaaactacctttaggacgtaaaagggttccggggtaccctaagtacgtaagggtttccgaaggttcgggtacaaggttcgggtaattaccggtaggggaaccgtaaggtaactttccaacttcctacgtaacgtactactaacgagttactgacgtaggacttaggtaacgtttattttccgaaccttaaaccctacttaccgttacgtaacctaaacgtacgtaaactttaccggttacgttttaccccgtaggtacccggtttacgggaacccgtaaggggaccctaggggtaccggtaaaggaccgttacgaaccgtacggtaacgttacggtacgggtactaccggtacctacctagttacccg

SEQ ID NO: 144326 - DNA, 758 bp, Homo sapiens
  misc_feature: GYAE6OF02J07RS.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctccgtgggctcctgctactctggctccgagatgccaattgtgacatccagatcgacccagtcctccactccctccctgtcagctattctggtaggagaccaggtacgtccacctaactctaacgtttcggacccggggaccaaaggttccgaagtactacctagttacggtaattacctaaagttttaaaacttaggttacttcgaacgacaacgaaaccgaaggaacaaccgacccctaattacttactacgaacttcgttaggtaccgtacgtaaccgaaaacttacgtttacggaacgtaacggtaccgggtaccacgttacgtaacggttacgaaggtcggtacgtaggtaggtacgttacgtacgggtaactaagtaacttccgtaactcgtaccaacgtactacgtaacgtacgttactacggtacgacggtaccggtagtacgtttaacgtttcgtacccgttaacttaccttacgtacgtaaactaaccgtagttaaaccgtttacgttaccgtttacccggaccggttaccggttacccggaacgggaaccggttaccggtaacggtacggtacgtaaccgttaacggtaacgtacggtaaccgttcggttaccggacgttaccgaccgttacctagttaccg

SEQ ID NO: 144327 - DNA, 757 bp, Homo sapiens
  misc_feature: GYAE6OF02IMJ84.53.27.C05.1.454.CMB.1.raw
  modified_base (200)..(200): a, c, t, g, unknown or other
  misc_feature (200)..(200): n is a, c, g, or t
  modified_base (746)..(746): a, c, t, g, unknown or other
  misc_feature (746)..(746): n is a, c, g, or t
tcagcgcgtatacacacgaccggtgctcgatttagacgcgatcgaagggtttgggggagtcagtctcagtcaggacacagcatggacatgagggtccccgctcagctccgtggggctcctgctactctggctccgagatgccaattgtgacatccagatcgacccagtcctccatccctccctgtcagcatctgtagganacagatcaccatcacgttggccgggactaagtcagacttctagttaggaacttacctaaagttttaaaagttggtaatacgaacgtacgaaacgaaaaccgaggaaaccaaaccgtaccccctttaaaattacttttccgtagtaacgtttcgttacgggtaccttacggtaacctaaaaactttcgttttaacggaaaccggttaaaacgggttccggggtaaccctaacgttaaccggtaaacggtttcgtaacgggttcggacgtaagggttacggtacgttacggtacgggaactaagttaacgtttcccaacttccgtaacgaacgtatacctaaacgtacgtcgtacgacgtagtacgtaacgtacgtttactttacgaacccttaaccgttaccgtaacgttacgtaacctaagtaacgttaaccgttaccgtttaccgttcccgttacgggtaccgttaccggaacgtaaccgggacgtacgggtagacgtaacgtacggtaacgtacgtaacgtcggtaccggtacgaccggtaccncgttacttccg

SEQ ID NO: 144328 - DNA, 905 bp, Homo sapiens
  misc_feature: GYAE6OF02J1J3T.53.27.C05.1.454.CMB.1.raw
  modified_base (200)..(200): a, c, t, g, unknown or other
  misc_feature (200)..(200): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtctccactccctcctgtcacgctatctgtagganacagacgtcaccatactacgttcggccggacaacgtcagtactctagttaggtaacttacctaattttaaagttggttattacgacgtaaccgaaacgaaaacccgagggaaaccaaccggtaacccccttaaagttactttacgtagttaacttacgttcggtacctacgtaacctaaacgttaccgtttacggtaacgtaaacgggttaccgggtaccctaacggttaccgtaaacgggtttacgacggttacgggtaccgtacgggttacggtacgttaccggtaacggggtaaccgtaaaggtaaccgtttaccgtaccgttacctaaccgtaagggtaaccccttaaacgtaaccgttaccggttaccgtcggtaaccggtacggtaccggttaacggttaaccgttttacgtttacccgtaaacccgttaacccgttaacccgtttaccgttaaacgtaaccctaaaaccggttaaccgggtttaaaccgttttaacccgttaaccggttttaaccccccgggtttaacggggtttacccggttacccgggtaaacccgggtaacccggggtaaccgggttaccgggttaacgggtaaacggtaaccggtaaaccggtaaaccgggttaaccggtaaccgtttacggggtaccgtaaaccggtacccggtaaccccgttaccggttacctttacccggg

SEQ ID NO: 144329 - DNA, 831 bp, Homo sapiens
  misc_feature: GYAE6OF02JKFEL.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctgggctcctgctactctggctccgagatgccaattgtgacatccagatcgacccagtcctccatccctcctgtcagctatcgtggtaggacgacgagacgtaccacctactccgtacgttcggacccgggtactaaacgtccgaaggtactacgtaagttacggtaaacttaccgtaaattttaaagtttaggtaacttacaaggaccaaacgtaaaccgaggaaaccgaaccggtaccccttaaattacgtttacgtacgtaacgtttcgtagggtacctaacgtaaacctaaccgttacgtttacggtaaaccggtaaacgggttaccggggttacctaacgttaacggttaaacggttacgtacgggtaccggtaaggtacggtacggtacgttacgggtaacggtaacgtaacgttaaccgtacctaccggttaccgtaaccgtaacgtacctaacgtaaccgtaggttccgtacgacgtacggacgttacggttacgtttacgtttaccgaaaccttaaccgttacgttacgttaacgtaaacctaaacggttacgttaacgtttaaccgtttaccggttaccggtaccggttaaccgttaccgggtaaccgtaaccggtaccggttacggttaacgggaacgttaagtaaccgggtaacgtaaccggtacgttacgggttaccgtacggaccgttaccgttacgtaccgtttaacg

SEQ ID NO: 144330 - DNA, 707 bp, Homo sapiens
  misc_feature: GYAE6OF02HB2ZP.53.27.C05.1.454.CMB.1.raw
  modified_base (226)..(226): a, c, t, g, unknown or other
  misc_feature (226)..(226): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtcctccatccctcctgtcagcatctggtaggagacagacgtcaccatcacttggccgganaagtcagatcattggaatcctaatttaaattggtatcagcaagaaacaggaacaacgtacccctaatacttctagtatcgttggctgacctaaacttactttacgacggtaaacggttcggggtacccaagttacgtaacgggtttcaggtaggacgtaaggtacggacgttcgtaggggtaacaggtaactttacaccgtttcaccgtacgtaactaccgaaacgtacgtactacgacgtacggcgttaggtaaccgttattttacggaaccttaaaccgttaaccttaccgttacgtaacctaaaccgtagttaacgtttaaccgttccgttttacccgtaccgggttaccgttaccgggaccggtaaccggggacccgttaacggggtaacgggtaacggtaacgtaacggtaaaccggtacggttaaaccggttggtaccgggttaccgtacggtaccctaaccgttaccgttacgg

SEQ ID NO: 144331 - DNA, 983 bp, Homo sapiens
  misc_feature: GYAE6OF02H1YGI.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctccgtggggctcctgctactctggctccgagatgccaattgtgacatccagatcgacccagtctccatccctccctgtcagcatctggtaggagacagagtccaccattctacgttcggcccgggacaagtcgaagtatctaagttacggaaacttaccgttaaagtttttaaaacgttagggttaactacgtaacggtaaccgaaaacggtaaaacccggaacgggtaaacccaaaaccggttaaccccccctttaaaagttttaaccgttttaccgttaacggttaaccgttttaccggttttacgggaccgtttaaccggtaaaccttaaaaacccgttaaccgtttttaacgggtaaccggttaaaacgggggtttacccgggggttaacccccttaaacggttaaccggtaaacgggttttacggtaagggttacgggtacggtaacggggttacgggtaacgtttaccggggtaacggggtaacgttaaacggtaaaccgttttacccgtaacccgtttaaccgtacccggtaacgtaaccttaaccgtaaaccgtacgttaccgtacggacgtacgggtacgttaacggtttaaccgttacgttttaccgtaacccttaaacccgttaccgtttaaccgttcggttaaaaccgaaccgttaaccggtttaaccgtttaacccgtttacccggtttttacccccgggtaccgggttacccgggtttaacccgggtaacccgggtaacccgggttacccgggttaacgggtacgggtaacggttaaccggttaaccggtaaccgggtaacccggtaacggttacgggttaccggtaccggttaccgacccggttacccgtacgtttacccgg

SEQ ID NO: 144332 - DNA, 645 bp, Homo sapiens
  misc_feature: GYAE6OF02F84PK.53.27.C05.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctcctgtcagcatcgtgtaagganacagactccacctatccacttcggccgganaagtcagatcattggaatcctaatttaacttggtatcagtacaagaaacgaggacaacgacccctaatacttctgtactcgtggctgacctaactacttagacgtaaggtcgggtacccatacgtaggttacagtggacgaggtagacgtacgtcggaactaggtacttcgtactctactacgtactacgaatactgtacgatacggtctacggtaacgttatttccggtaacctaaccgttaaccgttacgttacgtaactaacgtacgtaaccgttacgttacccgtttaccgtaccggttaaccggttcccgtaaccgggtaaccgggtaccgtacgggtacggtaaggtaacgttacggaaaccgtcggtaacgtacggtacggtccgtacggtccctacgtacgtttacccg

SEQ ID NO: 144333 - DNA, 656 bp, Homo sapiens
  misc_feature: GYAE6OF02F9ESK.53.27.C05.1.454.CMB.1.raw
  modified_base (221)..(221): a, c, t, g, unknown or other
  misc_feature (221)..(221): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcatctgtaggagacagagtcaccatcacttgccggnaagtcagatcattggaatcctatttaaattgtatcagcaagaaaccaggacaacgacccctaatattctagtatcgttggctcgactaaactacgttagacgtaaaggtcggggtaccctacgtacgtaaggttcaaggttcggacgtaggtaggagtcggtagggaacgtagtaacttaccacttctacgacgtaactactaaaccgtacgttcgtacgacgtacggtacgtacggtaacgtttacgtttacgaacccttaacccgttaaccgttaaccttacgttaaccaaacgtacgttaacgtttaaccgttaccgtttacccgtaccgggttaccgttaccgggacccgtaacgggaccgtacggtacggtaagtacgtacgtaacgttaccgtacgttacggtacggtacgtacacgtacctcgttacg

SEQ ID NO: 144334 - DNA, 695 bp, Homo sapiens
  misc_feature: GYAE6OF02JYKCB.53.27.C05.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtcctaccatcccgtcctggtcacgcatcgtgtaggagacagagtcactatcacttcgccgganagtcagatcagttaggaactcctaatttaaatggttatacagacagaaaccaggacaacgtacccctaatacttacngtaacttcgttacggtctacggaactaaaccttactttaggaactaaacggggtccgggttaacccgtactaccggtaaaggttacgtaggtacggtacgtaggttcggaacgtcgtacgggtaactaggtaacttactaccgttacgtaccacgtaactaaccgtaactaggtactcggttaccgacggtcgtacggtacgtttatttaccgtacctaaccttacttacctaagtaccgtaacacggttaacgttacgttaccgttaccggtacggttaccgttaaccgggaaccgtacggggtacccgttacgggtaacggtcgtaacgtacgtaacggttaccgtaaggttcggttacggtaccgtagtcccggtaacctgttaccg

SEQ ID NO: 144335 - DNA, 684 bp, Homo sapiens
  misc_feature: GYAE6OF02GUTNB.53.27.C05.1.454.CMB.1.raw
  modified_base (200)..(200): a, c, t, g, unknown or other
  misc_feature (200)..(200): n is a, c, g, or t
  modified_base (322)..(322): a, c, t, g, unknown or other
  misc_feature (322)..(322): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctccctgtcagcattctggtaagganacagatcaccatcacttcggccggcaagtcagatcagttggaatcctaatttaagttggtatcgagacaaacgaacgacgtaacaaccgacccttaattacttctagtacttcgttcgactnaacctaaacttcgttagacgtaagggtcggtacctagtcgtaaggttcaggtcgcgaggtggatacggtaggataagtacttcgactcgtactacgaactacgaactacgtcgtagacgtaggtcgtacggttaacgtttactttaccggaaccttaaaccgttacgtaccgttactaacccgtaaacggtacggtttaccgttaaccttaccgggttttacccggtaaccggttacccgggttaacccggtaaccgtaaccggggtacccggtaagggtaccgggtaaggtaaccgtacggtaaaccggtaccggttacggtacggtccggttaccgaccctttaccgaccttacgtaccg

SEQ ID NO: 144336 - DNA, 655 bp, Homo sapiens
  misc_feature: GYAE6OF02F0FDI.53.27.C05.1.454.CMB.1.raw
  modified_base (196)..(196): a, c, t, g, unknown or other
  misc_feature (196)..(196): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatccctcctgtcagcatctgtagganacagagtccacctatcacttcggaccgggcaagtcagatcgattggaatcctatttaaattggtatcagcagaaaccaggacaacgacccctaatattctgacttctgctgacaaactactttgacgtaagtcgggtaccatactaacggttcagtggcgtagtgacgtcgaggtacaagtactttacacgttctacgtacgtaactccgtaaacgtaggttacctaggaccgtaacgggtccttacggtaaaccgttacgtttttaccgaacccttaaacccgttacctaaccgttacgtaaccctaaacgtacggttaaccgtttaacgttaaccggttttcccgtacggtaacggttccgtaaccgtaacgggtaccgtacggtacggtaagtaccgtacgtaacggtaccgtaacggtacggtacggtaccgtacggtacctaccgtattacccg

SEQ ID NO: 144337 - DNA, 777 bp, Homo sapiens
  misc_feature: GYAE6OF02HHHSY.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctctgggctcctgctactctggctccgagatgccaattgtgacatccagatgaccagtctaccatccctccctgtcagctattcgtgtaggagacagagtcacctatcacgttcgaccggggactaaggtccagtactctagttaggaacttacctaaattttaaagttcggtaatcgacgtacaaggaaaccgaggaacaacgtacccctaattacgttactacgtattcgttgacgtcgaacctaaactactttacgaacgtaacgggtccggtaccgtaacgtacgtaaggtttcgtacggtacggtacgtaacggttaggtaacgttccgggtaaggtaacgtaacgttaacgtttaccgtaccgttactaccggtaacgtaaacgtaacctaacgtacgttccgaggtaccggtcggttaccgtaacggttaacgtttacggtttaaccgtaacccgttaaacctacgtttaaacctcggtaaacctaaacggttaacgttaaacggtttacccgggttaaccggttttacccgtaccgggttaaccggttacccgggaaccgggtaaccggggtacccggtaagggttacggtaaggtaaccgtaacgaacggtaccgtaccggtagggttacccgcggttaccgaccgtaccgttacttacccgg

SEQ ID NO: 144338 - DNA, 709 bp, Homo sapiens
  misc_feature: GYAE6OF02I61OP.53.27.C05.1.454.CMB.1.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
tcagcgcgtatacacacgaccggtgctcgatttagacgcgatcgaagggtttgggggagtcagtctcagtcaggacacagcatggacatgagggtccccgctcagctcctggggcctcctgctactctggctcgagatgccaattgtgacatccagatgacccagtctccatccctcctgtcagcatctgtagganacagagtccacagtcacgttggccgggtacaagtcagactcagttaggaatacctaagttttaaattggtatcagaccaagaaacccgaggaacaacgtacccctaaattacttacgtgtacttcgttggacctagaacctaaactacgtttagacgtaaagggttcgggaccctaagtacgtaacggtttacnggttacggacgtaaggtaggtaacttacggagggtacaaggttaaccttcgtaaccttactaccaacgtactaactaacgtaacgttcctacggacgtaacggtacctaacggttacgttaacgttttaccggaacctaaaccgtttaccgtaccgtcgttaaaccgtaacgtaaggtaccgttttaacgtacccggttttcccgtaacgggttacccgttacgggaacccgtaacgggaccgttagggacggtaaggtactaacggaacggaacgttaaccggtggtccggtaactcgaacccgtactaccgttacgg

SEQ ID NO: 144339 - DNA, 762 bp, Homo sapiens
  misc_feature: GYAE6OF02JC8SO.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctcgagatgccaattgtgacatccagatgacccagtctccatccctccctgtcagcatctgtaggagacagagtaccaccatccacgttcggccgggacaagtcaagtatctagttggaactacctaatttaaattggtatcagtacaagaaaccaggaaccaacgacccctaaatacttctgtactcttcggctagtaacctaacgttactttcgaacgtaaacgggttccggggtaccctaattacggtaaacggttacgtacggttacgggacgttaacggtacgggtaaccttcgggtaacggggaacctaaacggtaaaccgtttccgtaacgttacccgtaacctaaacggtaaccttaacccggaaaccgttacgttccgtaacgaccggtacggtaccgttacggtaacgtttagtttaccgtaaccgttaaacccgttaaccgtaccttcgttaaaccgtaaaccgtacggttaacgtttaaccgttaccggttacccgttaccgggtacccggttacgaacccggtaccgggtacccgtacgggtaccggtaacggtaccgtaaacgtaccggtacgttaaccggtacggttcgtaccgtacgaccctacgtacgtttacccg

SEQ ID NO: 144340 - DNA, 733 bp, Homo sapiens
  misc_feature: GYAE6OF02IAX17.53.27.C05.1.454.CMB.1.raw
  modified_base (99)..(99): a, c, t, g, unknown or other
  misc_feature (99)..(99): n is a, c, g, or t
  modified_base (179)..(179): a, c, t, g, unknown or other
  misc_feature (179)..(179): n is a, c, g, or t
  modified_base (194)..(194): a, c, t, g, unknown or other
  misc_feature (194)..(194): n is a, c, g, or t
  modified_base (307)..(307): a, c, t, g, unknown or other
  misc_feature (307)..(307): n is a, c, g, or t
  modified_base (700)..(700): a, c, t, g, unknown or other
  misc_feature (700)..(700): n is a, c, g, or t
tcagcgcgtatacacacgaccggtgctcgatttagacgcgatcgaagggtttgggggagtcagtctcagtcaggacacagcatggacatgaggtcccgntcagctcctgggctcctgctactctggctccgagatgccaattgtgacatccagatgacccagtctccatcctcctgacngcctatctggtaggnacaggctcaccatcgacttcgcgggactaagcgagatctaagttagaactactaattaaagttggtaatcacgacgaacgaaacgtaggaccaaacgtccctaattatcgtanaacttcgttcggacttcaacctaaactcgttttacgacgttaaaacggttcgggtaacctaagttaccgtaaaggtttcgagttacggacgtaggtacggtagtcgtaggggaactaggtaaatttccatttccgactaacgtcgaactacgaggttactcggtacgagcgttaaccgaagtttactttacgaccgttaaaacgttctaaacggttcctaacggttaaacccgtaggttaaaccgtttaaccgtttaaccggtttcccgtttaaccgggtaaacggtttaaccgggtaccggtaaacccgggttccggtaaccgggtaacggtaacccgttaaccggtacgtaaacccggtacgtaacccggttaacgtcgggtttaaacccncggtttaacccgaaccgtttaccccgtttacgg

SEQ ID NO: 144341 - DNA, 732 bp, Homo sapiens
  misc_feature: GYAE6OF02FIYVT.53.27.C05.1.454.CMB.1.raw
  modified_base (229)..(229): a, c, t, g, unknown or other
  misc_feature (229)..(229): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagntcattggaatccaatttaaattggtatacagcaacgaaacaggacaaacgcccctaatacttctagtacgtcttggtacgtgaacctaaactacgttttacgaaccgtaaaaggtcggggttaccccaattcccgtaaaggtttccgtaacgggttacgggtaactaggttcgggtaacgttacggtgggggtaaaccaagggttaactttactaccgtaccttacgaaccggtaataacctaaacgaacgttcgtacggactaaacggtcgtacggtaacggttaacgttttcggtaaccctaaccctttaacgttaccgttacgtaactaaaaccgtacggttaacgttttaaccttaaccggttttacccgttcgggtaacccggtttaccggggaccgtaaacggggtacccgtaaccggggttaggacggttaacggaaccgtaaggtaccggtaaacgttgggtacggtccgtacggtaccctacgtacgttaccgg

SEQ ID NO: 144342 - DNA, 853 bp, Homo sapiens
  misc_feature: GYAE6OF02JUOA7.53.27.C05.1.454.CMB.1.raw
  modified_base (214)..(214): a, c, t, g, unknown or other
  misc_feature (214)..(214): n is a, c, g, or t
  modified_base (552)..(552): a, c, t, g, unknown or other
  misc_feature (552)..(552): n is a, c, g, or t
tcagcgcgtatacacacgaccggtgctcgatttagacgcgatcgaagggtttgggggagtcagtctcagtcaggacacagcatggacatgagggtccccgctcagctccgtggggctcctgctactctggctccgagatcgccaattgtgacatccagatgacccagtcctcactccctccctagtcacgctattcctagtagggactacaggngtaccaccactcctacgttcgggcccgggactaacggtacacgtacttacctaagttacgggtaacttaccttaattttaaaagtttcgggttacttaccgagaccgtaacggaaaacccgaagggaacccgtaaaaccggttacccccttaaaattacttttacccgttacgttaaacgtttccgtttacgggtaccttacggtaacccttaaaacgttacccgttttaccggaaacgtaaaaccggggtttccggggtaacccttaacgttacggtaaacggttaccggtaggttacggacgtaggtacgtagtacgggtagtaacgagttacgtntacctcgtacactactacaacgtacgtactggactacggtcgtagttaaccgtttacgttacgttaccctaacccgtttacgtacgttacgttaaccgttaaactacgggttaccggttaaccgttttaccccggttacccgggtacgtttaaacccgggtaccggttaccgggtaaacccggtaaccccgggttaaggggtaaccgggtaaaccggaacgttaacgggaacccggttaaacggtaccgggttcggtttaccggaaaccgttcccggtaacgttcccctaaaggtttcccg

SEQ ID NO: 144343 - DNA, 600 bp, Homo sapiens
  misc_feature: GYAE6OF02G3FK1.53.27.C05.1.454.CMB.1.raw
  modified_base (222)..(222): a, c, t, g, unknown or other
  misc_feature (222)..(222): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttcggccggnaagtcagatcatgatctaatttaatgtatcagcaagaaacgagacaacgaccctaatacttctgattctgctgactaacgtacttagacgtaaggtcgggtccaagtcgaaggttcagtcggacgtaggtggtactcgtaggactagaacttcacttcacactatacgaacacgttcaggcaggcgtacgtacgttacttttcgaccgtaaaccttaccgtactacggtacctaaacacggtttaacttaaccgttacgttttaccccgtacgggtacccggtttaacggacccggtaacgggtaccggtacggttagggaacgtacgtacggaaacggtacgttaacgtcggtacgacgtacgaccgactacgtacg

SEQ ID NO: 144344 - DNA, 783 bp, Homo sapiens
  misc_feature: GYAE6OF02IT99V.53.27.C05.1.454.CMB.1.raw
  modified_base (775)..(775): a, c, t, g, unknown or other
  misc_feature (775)..(775): n is a, c, g, or t
tcagcgcgtatacacacgaccggtgctcgatttagacgcgatcgaagggtttgggggagtcagtctcagtcaggacacagcatggacatgagggtccccgctcagctccgtgggctcctgctactctggctccgagatgccaattgtgacatccagatgacccagtctccatccctcctgtcagcatctgtaggagacagagtccaaccaatcctacgttcggacccgggacaaagtcgaagtacttacgaatttaggaaacttacctaaagttttaaaagtttaggtaattcgaacgtaacgaaacggaaaaaccgaggaaaccaaacgacccccttaaattacgttactaggtaacttcgttacgggtacttagtaaccgtaaaacttaacttttaggaaccgtaaaacggtcggggtaacctaacgttacgtaaacggtttaccgaaggtcggtaacgtaaggtacggtaaacgttcggtaacggggtaaactaaacggtaagtttacctaccgttaccgtacgaaaccgtaataaccgaaacgtacggttactaacggtcgaacgggtctacggtaacgttattttaccgaaccttaaaccgttaacctaaccgttacgtaaccgtaaagtacggttacgtttaaccgtaccgtttacccgtacgggttaaccgtaccggtacgaaacggtaccggaacggttacggaacgtacgtaaaccgtaacggtaaccgtaacggttcggacggtaccgacggtacccgtaacctnttacccgg

SEQ ID NO: 144345 - DNA, 691 bp, Homo sapiens
  misc_feature: GYAE6OF02FN8LI.53.27.C05.1.454.CMB.1.raw
tcagcgcgtatacacacgaccggtgctcgatttagacgcgatcgaagggtttggggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatccacttgccgggcaagtcagatcattggaatcctatttaaattggtatcgagcaagaaaccaggaacaacgacccctaaatacttctgtattcgttggtctgactaaactacttttagacgtaaaggtcggggtacccaagtacgtaaaggtttacgaggttcggacgtaaggttgggtaactcggttaggggaactaaggtaaacttcctaactccgttacaacggtaactacgaaacgtacgttctacggacgacggtactaggtaaccgttagtttttacgaacctaaccgttaaccttacgttacgttaaccaaccgtaagtaacgtttaaccgtaccggttttaccccgacgggttaacccggttaccggtaacccgtaaccggggtacccgaaccgggttagggtaacggtaagaccgtaaacggtacggtaaccgtttggtacggtacgttcggaccctaccgtacgttaccgg

SEQ ID NO: 144346 - DNA, 862 bp, Homo sapiens
  misc_feature: GYAE6OF02JB0Q6.53.27.C05.1.454.CMB.1.raw
  modified_base (194)..(194): a, c, t, g, unknown or other
  misc_feature (194)..(194): n is a, c, g, or t
tcagcgcgtatacacacgaccggtgctcgatttagacgcgatcgaagggtttgggggagtcagtctcagtcaggacacagcatggacatgagggtccccgctcagctcctgggctcctgctactctggctccgagatgccaattgtgacatccagatgacccagtctccatcctcctgtcagcatctgtagganacagagtcaccatccacgttcggccgggacaacggtcgaggactcgtaagttacggaacttacctaaattttaaactttagggttaactcgtaacgtacgtaacgaaaaccgaacggtaaaccaaaccggtacccccttaaaattaccgtttacgtacgtaactttccgttacggggacttacggaacctaaaaccttacgtttacgaaccgtaaacgggttccggggtaccctaagtaccgttaaacggttcggtaagttacggacggtacggttaggacgttacggtacggaccgtaaaggttaactttaccctacgttaccgtaaccgtaaccgggtaactaacccggtaaactacgttaccgtaacgtacggtaccgggtaaccgttacggttaaccggttaacgtttttaccgaaacccgttaaacccctttaacccgtaacgtttaaccgtaaccgttaaaaccgtaccggtttaaacgttaaccggttttaaccccgttttccccgggttaaccggttaacccgggttcccgtaaaaccgggtaccgggtacccggttacgggttaccgggtaaacgtaacccgaacgggtaccggtaaaccgttacggttacggtaccggttacccggtaccgtaaccggtacccgtagtttaccccggg

SEQ ID NO: 144347 - DNA, 865 bp, Homo sapiens
  misc_feature: GYAE6OF02IIA6M.53.27.C05.1.454.CMB.1.raw
  modified_base (857)..(857): a, c, t, g, unknown or other
  misc_feature (857)..(857): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtctccatccctccctgtcacgcatctaggtacggagacagacgtccaccactcacgttcggacccgggtacaagtcgaagactacctagtttacggaacttaccgttaattttaaaagttggttaactaccgtaacgacgtaacggaaaaacccgaggaaaccgtaaacgtaaccccccttaaaagttaccgtttaccgttacgtaacgtttcgtttacgggtccttacgaacctaaaaccttacgtttacggaacgtaaacgggtttaccggggtaccctaacgttaacccggttaacggtttacggtacggtacggacggtacggtaggttacgtacggtagggtaactaaacggtttacgttaaccttacccgtaccgtaaccgtaaccgtaacgtaaacccgtaacggttacgttaccggtacgtaacggtccggtaaccggttacggttaaaccgttttcgttaacccggtaacccgttaaaccctttacccgttaaagttccgtaaaccgaaacgttaacccggtttaacgtttaacccgttccgggtttaaccccgttacgggtacccgggttaacccgtaccggggtaacccgtacggaccgggttacggaacggttaaccgtaaacggttaccggaaccggtaacgtacgggttacggtaccgtaacccggtcctaaccgtnttaaccgg

SEQ ID NO: 144348 - DNA, 543 bp, Homo sapiens
  misc_feature: GYAE6OF02ICK9H.53.27.C05.1.454.CMB.1.raw
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (537)..(537): a, c, t, g, unknown or other
  misc_feature (537)..(537): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaattggtatcagcagaaaccaggacaagcccctaatattctgatcttggctgacaaactactttgacaaaggtcgggtcccatacaaggttcagtggcagtggatcgtggacagaattcactctcacgatcaacngtctgcagctgacgtntttcgactaacctactactataccaactagtacgttactacgttttcccgtacggtacgtttcggaccgtaacggaccgtacgggtaggaagacgtacgaacggtacgtaacgttggtggtccgttaggccctaaccgtnttaccg

SEQ ID NO: 144349 - DNA, 740 bp, Homo sapiens
  misc_feature: GYAE6OF02F1TF6.53.27.C05.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcacctanctacttggccgganaacgtcagatcagttgaatcctaatttaaattggtatcagcagaaaccaggacaacgaccctaatatctagtatctggctagacaaactacgtttagacgtaaaggttcggggtaccctatacgtaaacggtttccgtaaggtacgggacgaaggtcggtacgtgtacggggaataacggtaacttaccgtacccgtttacctaaccgtaacgtaactactaaaccgtacgttacgtacggccgtaagggtaccgttacggttaaacgttagtttttaccgaacccgttaaacccttacttaaccgttagttaaacccgtaaacgtaacggtttaaaccgttttaaaccgttccggtttttaacccccggttaccgggttaccggtttacccgggtaacccgggttaaccggggaacccgtaccgggggtacggtaaacggtacgttaaccggtaacgtaccggtaaacgttcggttacgggttaccgttacgacccgtaaccgttcgtttacccg

SEQ ID NO: 144350 - DNA, 705 bp, Homo sapiens
  misc_feature: GYAE6OF02F6G17.53.27.C05.1.454.CMB.1.raw
tcagcgcgtatacacacgaccggtgctcgatttagacgcgatcgaagggtttgggggagtcagtctcagtcaggacacagcagtggacatgagggtccccgctcagctcctggggctcctgctactctggctcgagatgccaattgtgacatccagactagaccccagtctccatccctccctgtcagcatcgtgtaggagacagagtcaccatcactggccgggtcaagtcagatcattgaactctatttaattggtatcagtcaacgaaaccaggaccaacgacccctaatacttactaggacttcgttggacctagaacctaaactacgtttacgaacgtaacggttcggggtaccctagttaccgtaacgggttaccgaggttcggacgtagggttaggtacgttacggtacgggtaactaacggtaacgtttacctaccgttaccgtacgacccgtaataccgaacgttacgttccgtacggaccgtaacgggtaccgttaggtaaccgttacgtttaacgaccctaaccgtaacgtacttacgtaccgaaacgtaacgtacgttaaccgttacggtttacccgtacggtaaccgttccggtaacggtaaccgggtaccggtacgggtacggtaacggtacgtaaccggacggtacgtaacggtcggttacgggaccgtacgtaccgaccgtactaccgg

SEQ ID NO: 144351 - DNA, 754 bp, Homo sapiens
  misc_feature: GYAE6OF02I6WKN.53.27.C05.1.454.CMB.1.raw
  modified_base (150)..(150): a, c, t, g, unknown or other
  misc_feature (150)..(150): n is a, c, g, or t
  modified_base (623)..(623): a, c, t, g, unknown or other
  misc_feature (623)..(623): n is a, c, g, or t
tcagcgcgtatacacacgaccggtgctcgatttagacgcgatcgaagggtttgggggagtcagtctcagtcaggacacagcatggacatgagggtccccgctcagctccgtgggctcctgctactctggctccgagatgcctaattggtnacatccagatcgaccagttctccactccctccctagtcagctattcgtgtaggacgacagacgtcaaccagttccacgttcggacccggataacgtccagtactacgtagttacggaacttacctaaaagttttaaagttaggtactacgaacgaccaaacggaaaaccgacggaaccctaaccggtacccctttaaaattacttaccgtagtaacgtttcgtacggtccttaagaacctaaaacgtttacgttacggaaaccgttaaacggggttccgggtaaaccctacgtaaacggttaacggttccgtaaagggtcggtacgaaggttccggtaagttcgttaacggggaactaacgtacttaactacgtaccgtacgaacgtaactaccgtaaagtccgtacgtacggacgtacggtaccgtagttaacggttactttacgaacccgttaacttacccgtaacgttanaaccgttaacgtaacgtacttaaccgttaccgttcccgtaggtacccgttcggacgttaccgacgtacggtgtaacggactacggacgtaaccggacgttacgtcgggtacttacggcctacgtcgttacg

SEQ ID NO: 144352 - DNA, 663 bp, Homo sapiens
  misc_feature: GYAE6OF02I2ZNH.53.27.C05.1.454.CMB.1.raw
  modified_base (135)..(135): a, c, t, g, unknown or other
  misc_feature (135)..(135): n is a, c, g, or t
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
tcagcgcgtatacacacgaccggtgctcgatttagacgcgatcgaagggtttgggggagtcagtctcagtcaggacacagcatggacatgagggtccccgctcagctcctgggctcctgctactctggctccganatgccaattgtgacatccagatgacccagtctccatcctccctgtcagcatctgtagagtacagagtcaccatcacttgccgggcacgtcagatctacttggaactctaatttaaacgtggttatacgacgacaagaaaccgtaggaactacgaccccttaatattcgtagacttcgtgctgaacactattcgaacgaagtccgggtaccagtacgaaaggtttnacggttgacacggttaggattcgngggaactaggtaattccgaactcgtacctaacgtacgtaacgtaaccctagtaccgttacgaccgtaacgggtccttaacgggtaactttacgtttcaaccgtaaaacgttacctaaccgtactaaccgtaaatacggttaagttaccgttaccgttacccggtaccgggttacggtttccgaaccgtttaacgggacgtaccgttagggaaactcggtaaccgtcggaacccgttagtacggaccggttagtcccgaccgttaaccgtagtttacccg

SEQ ID NO: 144353 - DNA, 935 bp, Homo sapiens
  misc_feature: GYAE6OF02JVRRK.53.27.C05.1.454.CMB.1.raw
  modified_base (100)..(100): a, c, t, g, unknown or other
  misc_feature (100)..(100): n is a, c, g, or t
  modified_base (168)..(168): a, c, t, g, unknown or other
  misc_feature (168)..(168): n is a, c, g, or t
tcagcgcgtatacacacgaccggtgctcgatttagacgcgatcgaagggtttgggggagtcagtctcagtcaggacacagcatggacatgagggtcccgntcagctccgtggggctcctgctactctggctccgagatgccaattgtcgacatccagatgaccagtcncatcctcctgtcagcatctgaggacacagagtcaccatcctacttcggccgggactaacggtcaacgtacttacgtaagttacggtaacttacccttaagtttaaacgtttagggtaactacgtaacgaaccgtaacgaaaaccgtaaggtaaacctaaccggtaacccccttaaagttaccttacgtacgtaacgttaccgtttaggtaccttacggtaacctaaaactaccgtttacgtaaacgttaaacggttaccgggtacccgtaacgttaccgtaaacggttttaacgtaacggtacgggtacgttaacggttacggtacgttacgttacgggaaccgttaggtaaccgtttaccgtaacccgttcgtaaccgtaccgtaaacgttaccgtaaacgttaccgttacggtacgttaaccggtaacggtacgtaacggtaccgttttaaccgttttacccggaaaccgtttacccgtttaacgtaacccggttaacggtaacccgttaaacggttacccggttaaacggtttaccgtttaaccccggtttaaccgggtttaacccggttacccgggtttaacccgggtaacccgggtttaaaccggggttacccccgggttaaacgggggtttaacccggtaacgggtttaaacccgggtttaacccgaaaccggggtttaaaccggtaacccgggttaaccggggttaacccggtaccgggttaccggtaaccccgtaacccggttcccgtttaaacccggg

SEQ ID NO: 144354 - DNA, 589 bp, Homo sapiens
  misc_feature: GYAE6OF02I7V9J.53.27.C05.1.454.CMB.1.raw
  modified_base (224)..(224): a, c, t, g, unknown or other
  misc_feature (224)..(224): n is a, c, g, or t
  modified_base (441)..(441): a, c, t, g, unknown or other
  misc_feature (441)..(441): n is a, c, g, or t
  modified_base (585)..(585): a, c, t, g, unknown or other
  misc_feature (585)..(585): n is a, c, g, or t
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttcggccggganaacgtcagactcattggaactcctaattttaaattggtaatcgagacaagaaacaggaacaaacgaccctaaatattctgtattcgttggctcgactaaactactttcgacgtaaggtcgggtacccagtacgtaaggtttcaggttcgggctaggtcggtatcgtaggactaagtaacttccactctacacgtactacaacagttcagctacggtntacggtagtatttcgacctaaccttactacttacgtaccaacgtagttacgttacctacgtttccgtacggtaccgttacggaccgacggtacgtacggtagtaacgactacgaacgtacgtacgtggtcgacgtgactacgtnttcg

SEQ ID NO: 144355 - DNA, 650 bp, Homo sapiens
  misc_feature: GYAE6OF02FQWIS.53.27.C05.1.454.CMB.1.raw
tcagcgcgtatacacacgaccggtgctcgatttagacgcgatcgaagggtttgggggagtcagtctcagtcaggacacagcatggacatgagggtccccgctcagctcctggggctcctgctactctggctccgagatgccaattgtgacatccagatcgacccagtcctccatccctccctgtcagcatctaggtaggagacagagtcaccatactacgttcggccgggcaagtcagatctattggaatacctaattttaaattggtatcagacaagaaaccaggaaccaacgacccctaaattacttctagtattcgttggctgacaaacttcgttagaacgtaaggtcgggtacccagtacgaaggttcgagttggctaggtggatcggtggaactagtactctactctacgaacgtatacaagtcgtcgtacgcgtacggcttaggtaacgttacttttacgaacccttaaccttacctaacgttcgtaaccaaacgttacggttaacgtttaccgttaaccgttttcccgtaacgggttaccggttccggaacgggtaccgggtaccgtaacggggtacggtaacgtaacgtacggaacggtacgtaacggttcggtcggtagtccggacctactacgttaccgg

SEQ ID NO: 144356 - DNA, 735 bp, Homo sapiens
  misc_feature: GYAE6OF02GBOPX.53.27.C05.1.454.CMB.1.raw
  modified_base (139)..(139): a, c, t, g, unknown or other
  misc_feature (139)..(139): n is a, c, g, or t
  modified_base (702)..(702): a, c, t, g, unknown or other
  misc_feature (702)..(702): n is a, c, g, or t
tcagcgcgtatacacacgaccggtgctcgatttagacgcgatcgaaggggtttgggggaggtcagtctcagtcaggacacagcatggacatgagggtccccgctcagctcctggggctcctgctactctggctccgagntgccaattgtgacatccagatcgaccctagtcctccactccgtccctgtcagctatcgtggtaggacgacgagtacgtccaacctactccgtacgttcggccggggtaactaacggttacgaacggtacttaccgtaagtttacgggtaaactttacccgttaaaagtttttaaaacgttacgggttaaccgttaccgaacggtaacccgtaaacgtaaaaccccggaacgggtaaacccgtaaaccggtaacccccgtttaaagttacgtttaccgtacgttaacgttcggttacggccgtaaccgaaccgttaaacttacgttagaacgtaacggtccgggtacctagtacgtaacggtttacgacgggtggacgtagtcggtacgtacggtacggtaacgtacgtacttaccggaccttcgtaacgtaacgaataccgtaacgtagtcacgtgtaacgtctaggttacgttcttaacgaccttaactactacgagtacaacggttggtaccttacgttccgtccgtagcgtacacgtacgacgtggagtacgcacggtanaccggtacgtggtcgtacgcgtactacgtctcg

SEQ ID NO: 144357 - DNA, 701 bp, Homo sapiens
  misc_feature: GYAE6OF02JB9OD.53.27.C05.1.454.CMB.1.raw
  modified_base (452)..(452): a, c, t, g, unknown or other
  misc_feature (452)..(452): n is a, c, g, or t
  modified_base (470)..(470): a, c, t, g, unknown or other
  misc_feature (470)..(470): n is a, c, g, or t
  modified_base (572)..(572): a, c, t, g, unknown or other
  misc_feature (572)..(572): n is a, c, g, or t
tcagcgcgtatacacacgaccggtgctcgatttagacgcgatcgaagggtttgggggagtcagtctcagtcagacacagcatggacatggacggtccccgctcagctccgtgggctcctgctactgtcggctccgagatgcctaagttcgtgacactccagtactcgaccctgtctccagtccctcctagtcacgtcctactcgtgtaaggacacgaagtcgtaccacctaatccgtaacgttggcccggtataaaccggttgaacgtacgttctaacgttagggtaaccttacgtaactttaaggttacgtaacgtctaaccgtacgaaccgaacgacgaaccttaaccgaccttaactaccgttcgtacctacgttacgtcgtacctacgaacgtaaccgttactttacggacgtaacggtcgtaccgtacgtacgggtacgtttacggnggttacgaccgttaaggngtaacgttcgtacggactaacgtactactacgtcgtacgtacgacgtactacgtacgtctacggtcgacgtactacgttacgttacgttcggactaccgttntaacgcgttacaacgttacgtacgtacgttacgttccgttaggaccgtacggacgtaaccgtaggacgttaccggagaagttaccgtacggtacgtacgtacggtcgtccgtacgaccgacgtcgtccg

SEQ ID NO: 144358 - DNA, 517 bp, Homo sapiens
  misc_feature: GYAE6OF01EZBX1.33.57.F02.1.454.CMB.1.raw
  modified_base (408)..(408): a, c, t, g, unknown or other
  misc_feature (408)..(408): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctggagggtccctgagactctcctgtgcagccgctggattcagcttcagtgactactacatgggctggatccgacaggctccgaggggagggctggagtggatttcattcattagtaatcgtcttgctcccagcgtccacttagaatatgacagaatctgtgagaggccgtaattccaccgtcnccagacgacaacgccgaagacnctcacttattcngcagatgaacngcctgagacgccggaggacacgggtctagtacttagttagttggtaggggagttggaattgggg

SEQ ID NO: 144359 - DNA, 512 bp, Homo sapiens
  misc_feature: GYAE6OF01EWDCR.33.57.F02.1.454.CMB.1.raw
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctggagggtccctgagactctcctgtgcagccgctggattcagcttcagtgactactacatgggctggatccgacaggctccgagggaagggctgggagtggatttcattcattagtaatcgtcttgctcccagagtccattagaatatgacagaatctgtgagaggccgattccaccgtctccagagacaacgccgagagctcactatttcngcagatgaacngcctgagaggccgaggacacggctgtcttattattaggtgggtaggtggtaag

SEQ ID NO: 144360 - DNA, 701 bp, Homo sapiens
  misc_feature: GYAE6OF01CJ0XW.33.57.F02.1.454.CMB.1.raw
  modified_base (261)..(261): a, c, t, g, unknown or other
  misc_feature (261)..(261): n is a, c, g, or t
tcagtacacacactcacgaccggtgctcgatttagctcgatatagtgagctctgggagaagagccccagccccagaattcccaggagtttccattcggtgatcagcactgaacacagaggactcacatggagtttgggctgagctgggttttccttgttacaattataaaaggtgtccagtgtcaggtgcaactggtggagtcgtgggggagacctggtcaaggccgtgggacgggtcctgagactctcctgtgcagccgntggattcagtcttcagtgactactacagtgggctggactcccggacaggcctaccgaagggggaacggggtctagggaggtggtatttcaattctaatttaaggtaattcggtcttcggccctacccagtacgttaccctaattaagaaatgtacgacaagtaatcgtaggtggaaggacggtcccgtatttccgaacccgtctacccgaaggaacgaaccgaaacggtcccggaagtacgcccgttacaacttttaacgtttcccgaagggtaccaaaggttactaacgggaaccacggtccccgttaaggggaaacggtaccggaccccggggaaaggggtaacccgacccgggttcgtttacggttaaccgttttaagttttacgggttggggggtaacgggggggaagggtttaagggtaaacgttttgggggggg

SEQ ID NO: 144361 - DNA, 565 bp, Homo sapiens
  misc_feature: GYAE6OF01B7KNA.33.57.F02.1.454.CMB.1.raw
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctggaggtccctgagactctcctgtgcagccgctggattcagcttcagtgactactacagtgggctggatccganaggctccgagggaagggctagggagtggattcgattcattagtaatcgtnttgctcccagacgtcacttagaatgngacagtaatctggtgagcgccgtattcaccgtcacaganaaccgacgccgaanagcctanacttattcgnacgaagntacgaacncgtacgagacgacggccggaaggtaccaaccgggtctacggttaacttaacggtttaagtttggggacggggggttaaagttcggggtaaaaggtttcgggggg

SEQ ID NO: 144362 - DNA, 175 bp, Homo sapiens
  misc_feature: GYAE6OF01EOVUG.33.57.F02.1.454.CMB.1.raw
  modified_base (173)..(175): a, c, t, g, unknown or other
  misc_feature (173)..(175): n is a, c, g, or t
tcagtacacacactcacgaccggtgctcgatttagctcgatatagttgggtttgggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 144363 - DNA, 532 bp, Homo sapiens
  misc_feature: GYAE6OF01DJGIS.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctggagggtccctgagactctcctgtgcagccgctggattcagcttcagtgactactacatgggctggatccgacaggcctccgaggggaagggctgggagtggatttcattcattagtaatcgtcttgctccagagtccacttagaatatgcagaatctgtgagagggcccattccaccgtctccagacgacacgccgagacgctcaacttatttctgcagatgaacagcctaggagacgccgaaggaccgacgggtctaggtcttaagtttacgttgggtaggggtaaggtgggtaaagttcgggg

SEQ ID NO: 144364 - DNA, 557 bp, Homo sapiens
  misc_feature: GYAE6OF01CPY3V.33.57.F02.1.454.CMB.1.raw
  modified_base (375)..(375): a, c, t, g, unknown or other
  misc_feature (375)..(375): n is a, c, g, or t
  modified_base (472)..(472): a, c, t, g, unknown or other
  misc_feature (472)..(472): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttggctgagcgtggtttctgtacaattataaagtgtccagtgtcaggtgcaactgggtggagtcgtgggggagacctggtcaagcctggagggtccctgagactctcctgtgcagccgcgtggattcagcttcagtgactactacagtgggctgggactccgacaggcctccgaggggaaggggctgggagtggatttcattcattagtatcgtcttgctccgagcgttccacttagaatntgacagtatctggtgagacggcctattccacccgtctccgaagacgaaccaacggccgaagcgcctacgtacttatttcgagacagtactacgaacncgccgtaggacgcggacccggaaggacccgacgggtcttcgttacttagttacgttagggtaggggtaaggtggtaaggttgggg

SEQ ID NO: 144365 - DNA, 827 bp, Homo sapiens
  misc_feature: GYAE6OF01BWXZ5.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcacatggagtttgggctgagcttgggttttccttgttacaattataaaaggtgtccagtgtcaggtgacaacgtgggtggagtcgtgggggagaccgtggtcaagccgtgggacgggtccctaggagacctctccgtgtgcaggccgtctggacttcgagtcttacgagtacgaaccttaactacgagtcggggtctacggactcccggaacgacgggccctaccgggaaggggggaacggggcgttaggggaggttagggttacttttaccaagtttacgtaagttttaacggtaacttccggtttacgtttcggacccttaccccgaaaggtacgtttaccccgaagttttaaaggaaactttacgtacggtacctaaaggttaacttccggttaaggtacggaacggtaccgggtacccgttaaagttccccggtaaccttccgtaaccgaagggaaccgaacccgtaaccgaccgggaagtaaccgtacctactaaccgtttaacgtttccgagaaccgtaaggtaaccgttaacggaacccgtacggtaccccgtagggaaaccggtaacccgggaacccgggtaaacgggtaacccaacgggggtttcccttaaggggtttaccctttaagggttttaacggttcggggggtaaagggggggtttaacggttagggggtttaaacggtttacgggggg

SEQ ID NO: 144366 - DNA, 523 bp, Homo sapiens
  misc_feature: GYAE6OF01DVUN4.33.57.F02.1.454.CMB.1.raw
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggggagacctggtcaagcctggagggtccctgagactctcctgtgcagccgctggattcagcttcagtgactactacagtgggctggatccgacaggctaccgaggggagggctgggagtggattcattcattagtatcgtcttgcctccagtacgtccattagaactatgacagtaactcgtgtagagacggcctattccacgtctacagacgacacgccgagcgctcacttattcngcagatgacngcctagacgacgccggagaccacggtctagtcttaagttggttaggagggtaaggtggtaagttggg

SEQ ID NO: 144367 - DNA, 629 bp, Homo sapiens
  misc_feature: GYAE6OF01BQIUW.33.57.F02.1.454.CMB.1.raw
  modified_base (302)..(302): a, c, t, g, unknown or other
  misc_feature (302)..(302): n is a, c, g, or t
  modified_base (441)..(441): a, c, t, g, unknown or other
  misc_feature (441)..(441): n is a, c, g, or t
  modified_base (601)..(601): a, c, t, g, unknown or other
  misc_feature (601)..(601): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaaggtgtccagtgtcaggtgcaacgtggtggagtcgtgggggagacctggtcaagccgtggacgggtcctgagctctcctgtgcagccgctggattcagcttcagtgactactacgatgggctggactccganaggctccgaggggaagggctgggagtggtatttcgattctaagtttaggtaactcggttacttcgccttcccgagtacgttcccaagtttaagaatatggactaagaatcgtggtagacgaggccgtattccaaccgtntaccgaagacgaacgaccgccgaagtagcctacaacttactttcaggaccaaggacttacggaaacctacggaccctagggaaacgaccgggacccggaaggaaccccggtacggtcttacgggtttacttaagggtttaacgtttggggtaacgggggnggggttaaacggtaagtttacggggggg

SEQ ID NO: 144368 - DNA, 590 bp, Homo sapiens
  misc_feature: GYAE6OF01DNWBM.33.57.F02.1.454.CMB.1.raw
  modified_base (224)..(224): a, c, t, g, unknown or other
  misc_feature (224)..(224): n is a, c, g, or t
  modified_base (314)..(314): a, c, t, g, unknown or other
  misc_feature (314)..(314): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagcttgggttttccttgttacaattataaaaggtgtccagtgtcaggtgcaactggtggagtcgtggggganaccgtggtcaagcctggagggtccctgagactctcctgtgcagccgctggattcagcttcagtgactactacagtcgggctggatccganaggctccgagggaagggctgggagtggtattcattcatttagaattcgtcttcgctcccgagtacgtaccctaacgttagaatagtgactaagaattcgtaggtagacgacggtcctattccaccgtcacgagacgacaacgccgagctacctactacttacgttcgtgactagtaactacggaacctacgtccgtaggaacgaccggccggtaaggaaccctacgggtcttagttacttaacgtttaggtaggggtagggtagggtggtaaaggg

SEQ ID NO: 144369 - DNA, 493 bp, Homo sapiens
  misc_feature: GYAE6OF01AHVWV.33.57.F02.1.454.CMB.1.raw
  modified_base (343)..(343): a, c, t, g, unknown or other
  misc_feature (343)..(343): n is a, c, g, or t
  modified_base (381)..(381): a, c, t, g, unknown or other
  misc_feature (381)..(381): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcgtggtttctgtacgattataaaggtgtcagtgtcaggtgcaactggtggagtcgtgggggagacctggtcaagcctggagggtccctgagactctcctgtgcagccgctggattcagcttcagtgactactacatgggctggatccgacaggctccgaggggaagggctgggagtggatttcattcattagtatcgtnttgctccagagtccattagaatatgcagatctgtgagngccgattcaccgtctccagacgacaacgccgagngcctcactatttcngcagatgaacngcctgacgngccgaggtacacggntgtactattagtgagggagtggaagtggg

SEQ ID NO: 144370 - DNA, 553 bp, Homo sapiens
  misc_feature: GYAE6OF01DVS86.33.57.F02.1.454.CMB.1.raw
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
  modified_base (455)..(455): a, c, t, g, unknown or other
  misc_feature (455)..(455): n is a, c, g, or t
  modified_base (471)..(471): a, c, t, g, unknown or other
  misc_feature (471)..(471): n is a, c, g, or t
  modified_base (495)..(495): a, c, t, g, unknown or other
  misc_feature (495)..(495): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaaggtgtccagtgtcaggtgcaacgtggtggagtcgtgggggagacctgggtcaagccgtgggaggtccctgagactctcctgtgcagccgctggattcagcttacgagtcgactactacatgggctggactccgacaggctcgaggggacgggctgggagtggattcattcattagtaatcgtntgctccagacgtcattagaatntgacaagatctaggtgagtacggcctattccaccgttcnccgaagacgaccaacggccgaagngcctcgcttatttcgngacagtactacgaacngtcctgacgagccggaaggacccngggtcttacggtattaagtttacggtacgggttagggtacgggtggtaagttaggggg

SEQ ID NO: 144371 - DNA, 551 bp, Homo sapiens
  misc_feature: GYAE6OF01CKKQ4.33.57.F02.1.454.CMB.1.raw
  modified_base (291)..(291): a, c, t, g, unknown or other
  misc_feature (291)..(291): n is a, c, g, or t
  modified_base (473)..(473): a, c, t, g, unknown or other
  misc_feature (473)..(473): n is a, c, g, or t
  modified_base (486)..(486): a, c, t, g, unknown or other
  misc_feature (486)..(486): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtggggggagacctggtcaagcctgggacgggtccctgagactctcctgtgcagccgcgtggattcagtcttcagtgactactacngtgggctggactccgacaggcctccggaggggacgggctgggagtggtatttcattcatttagtaatcgtcttgcctcccgagtacgtaccatttaagaattagtgactagaattcgtgtaggagacggcctattccgaccgtctaccgagacaccgacgccgagcgctactacttattcgngctagatacgacncgcctagacgcgaccgagacacggtctacgtacttagttgttaggtagggaggtggtaagttggg

SEQ ID NO: 144372 - DNA, 626 bp, Homo sapiens
  misc_feature: GYAE6OF01D5Z63.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctgggagggtccctgagactctcctgtgcagccgctggattcagtcttcagtgactactacagtgggctggactccgacgaggctccgaggggaaggggctgggagtggtatttcattcatttagtaattcgtcttcgcctcccagtacgtcctacttagaattatgacaagtaattcgtagtagaggtacggcccgtattcccgaccggttctacccgaaggtaacgaccaaccggccgaagacgtcctacgtactttatttccgagtacaagtacgtagaaccacggtacccgtagggaacgaccgggcccggaaacgggacccgacgggttcttacggttactttaaggtttcggttaggggttagggggtacgggttagggtaacggtttagggggg

SEQ ID NO: 144373 - DNA, 628 bp, Homo sapiens
  misc_feature: GYAE6OF01ED47N.33.57.F02.1.454.CMB.1.raw
  modified_base (223)..(223): a, c, t, g, unknown or other
  misc_feature (223)..(223): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggganacctggtcaagccgtggagggtccctgagactctcctgtgcagccgctggattcagtcttcagtgactactacagtgggctggactccgacgaggcctccgaggggaagggtcgtagggagtggtatttcattactagttagtaactcgttcttcgcctaccgagtacgtacctaattagaattagtgacaagtaacttcgtaggtagaaggacggtaccgtaattcccgaacccggttcctaccgaaggacgaccaaccggccgaagcgtacctactaactttactttcgacgacaagtatacgaactacggcctaggaacgacggtaccccgggaaggacccgtacgggtcttcggttaacgttagtttaggttacggggtagggggtaggtgggttaaaggg

SEQ ID NO: 144374 - DNA, 589 bp, Homo sapiens
  misc_feature: GYAE6OF01DPPDJ.33.57.F02.1.454.CMB.1.raw
  modified_base (479)..(479): a, c, t, g, unknown or other
  misc_feature (479)..(479): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattaataaaaggtgtccagtgtcaggtgcaacgtggtggagtcgtggggggagaccgtggtcaagccgtgggacgggtccctgagactctcctgtgcagccgctggattcagtcttcagtgactactacagtgggctggactccggacaggctaccggaggggaaggggctagggaggtggtatttcgatttcatttagtaatcgtcttgcctccagcgtcacttagaatatgacagaatctgtagagacggcctatccaccgtcctcgaaggacgaaccgaacggccgaagacgtcctacaactttactttcgngactaagacgtacgaacacgtccgtaggacgacggacccgggacggaccgaccgggtcttacgttcttaagtttacggttgggtagggggtaaggtgggtaagttagggg

SEQ ID NO: 144375 - DNA, 661 bp, Homo sapiens
  misc_feature: GYAE6OF01CTDGM.33.57.F02.1.454.CMB.1.raw
  modified_base (291)..(291): a, c, t, g, unknown or other
  misc_feature (291)..(291): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttggctgagcttgggttttccttgttacaattataaaaggtgtccagtgtcaggtgcaacgtgggtggagtcgtgggggagacctggtcaagcctgggagggtccctgagactctcctgtgcacgccgctggattcagtcttacagtgactactacngtggggctgggactccgacaggctaccggaggggaagggctgggagtggctgtcatatcgtcttcgtggggagtgagttgggtccgcgttcgttcgacggccggtactcggttggtacggacggggtccgtaagttcgacggtacctaaccgtttaccgaacggtacgaaccgaaacccggaccccaaaaccgtaacccttccccgttacgaccctacgttacctacccgaagtaacgtacggtaacctaaccgtcggaccggacggaaccggaccggaaccgaccggtacttaacgttacttaacgttacgtcggttacgaccgtaacgtaccgttaaccctttaagtaacggtcgtaacggtaccggg

SEQ ID NO: 144376 - DNA, 599 bp, Homo sapiens
  misc_feature: GYAE6OF01CK85N.33.57.F02.1.454.CMB.1.raw
  modified_base (214)..(214): a, c, t, g, unknown or other
  misc_feature (214)..(214): n is a, c, g, or t
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
  modified_base (430)..(430): a, c, t, g, unknown or other
  misc_feature (430)..(430): n is a, c, g, or t
  modified_base (507)..(507): a, c, t, g, unknown or other
  misc_feature (507)..(507): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaacgtggtggagtcgtggggganacctggtcaagccgtggagggtccctgagactctcctgtgcagccgctggattcagcttcagtcgactactacagtgggctggatccganaggctccgaggggaaggctgggagtggtattcattcattagtaatcgtcttgcctacccagacgtcctaattagaaatntagacagaatcgtagtgaggtacgggccctaattccgaacccggttntacccgaaggaacgaaccgaaaccggccgaagacgtacctacgtaaccttagtttccgagacaagtattacgaaacncggtaccctaggaacgacggcccggaaaggaccacgggtcttaggtaccttaagttacggttgggagggggtaggttagggaagtttggggg

SEQ ID NO: 144377 - DNA, 605 bp, Homo sapiens
  misc_feature: GYAE6OF01EVWKE.33.57.F02.1.454.CMB.1.raw
  modified_base (223)..(223): a, c, t, g, unknown or other
  misc_feature (223)..(223): n is a, c, g, or t
  modified_base (318)..(318): a, c, t, g, unknown or other
  misc_feature (318)..(318): n is a, c, g, or t
  modified_base (409)..(409): a, c, t, g, unknown or other
  misc_feature (409)..(409): n is a, c, g, or t
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggttttccttgttacaattataaaaggtgtccagtgtcaggtgcaacgtggtggagtctggggganaccgtggtcaagcctggagggtccctgagactctcctgtgcagccgctggattcagtcttcagtgactactacagtcgggctggactcccgacgnggcctaccggaggggaacggggtctgggagtggtatttcattcaattagtaactcgttcttgcctcccaggacgttccattaagaattagngacagtaatcgtagtagaggacggccgtagttccaccgtctaccgagacgaaccgacgccgagacnctactaactactttcgngactagtatacgaaccgagtcccgtaggaaccgtaggaccccggaagggacccgtacgggtccttaggttacctttaagtttaggttagggtagggggtagttgggtaaaggg

SEQ ID NO: 144378 - DNA, 630 bp, Homo sapiens
  misc_feature: GYAE6OF01BRLZ9.33.57.F02.1.454.CMB.1.raw
  modified_base (536)..(536): a, c, t, g, unknown or other
  misc_feature (536)..(536): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtccagtgtcaggtgcaacgtgggtggagtcgtgggggagaccgtggtcaagccgtgggacgggtccctgagactctcctgtgcagccgctggattcagtcttcagtcgactactacagtgggctggactccgacgaggcctaccggaggggaacgggctgggagtggtattttcatttcaatttagtaactcgtcttcgcctacccgaagtcgtacctaagttaagaaattagtgactaagtaacttcgtaggtagacggtacgggtaccctaagtttcccgaacccgttaccgtaccgaaggaacgaaccgaaccggacgagacgtctactacttatttcgagactagactacgaacncgtccgtaggacggaccggccggaacggaccgtaccggtcttacgttacttagtttacggttgggtaggggtaaggttagggtaggtttagggg

SEQ ID NO: 144379 - DNA, 622 bp, Homo sapiens
  misc_feature: GYAE6OF01DDPNN.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtccagtgtcaggtgcaactgggtggagtcgtggggggagaccgtggtcaagccgtggacgggtccctgacgactctcctgtcgcacgccgctggattcgagtcttcagtgactactacagtgggctggatccgacaggctcggaggggagggctgggagtggtatttcgattactagttagtaatcgttcttgctctcagtacgtacctattaagtaatagtagacaagtaatcgtgtagacggacggtccgtaatttccgacccgttcctaccgaaggtaccgaaccgaacggcccgaagaccgtccttaccaactttacgttcgtacgaccgtaagtacgtacggaacctacggccgtaggaagtacgggacccggaaggaccgtacgggtcttcggttactttaaggttacggttggggtaaggggtaggttgggtaacggg

SEQ ID NO: 144380 - DNA, 656 bp, Homo sapiens
  misc_feature: GYAE6OF01CCP6P.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctgggagggtccctgagactctcctgtgcagccgctggattcagcttcagtgactactacagtgggctggactccgacaggcctaccgaggggagggctgggagtggtatttcattcagttagtaactcgttcttgcctcccgagtacgtccactttaagaattagtgaccaagtaacttcgtggtagaacggcgggacccgtatttcccaacccggttccacccgaaaggaccgaaaccaaccggtcccgaaggtacgccttaccgtaactttacttttccgagtacctaagtactacgaaaccacggtcccgttaagggaccggaaccgggcccgggaaacggggtacccgaacccggggtctttacggtacgtttaagttttacggtttggggaggggggttaaggttgggggtaaaagtttggggggg

SEQ ID NO: 144381 - DNA, 700 bp, Homo sapiens
  misc_feature: GYAE6OF01CEEQQ.33.57.F02.1.454.CMB.1.raw
  modified_base (626)..(626): a, c, t, g, unknown or other
  misc_feature (626)..(626): n is a, c, g, or t
tcagtacacacactcacgaccggtgctcgatttagctcgatatagtgagctctgggagaagagccccagccccagaattccaggagtttccattcggtgatcagcactgaacacagaggactcaccatggagtttggctggagtcgttggggttttccttgttaacaaattaagtaaaaggtgtccagtgtcaggtgacaacgtgggtgacgtcgtgggggacaccgtggcaaggccgtagggacgggtccctgaacgccgtcttccgtggtgcacgccgtcgtggacttcgagtcgttcagtcgacctactacgagtgggctaggactcccgacgcggccgtacggaagggggaacggcgtagggaggtggtaactttcgtaattcgtaaagtttacgttaacgttccggttctttcggaccctttaccggacgtaacgttaccctaaagttaagtaaatcgtacgacgaagtacttcgtggtagacgacggtcccgttaactcccgaaccgtgtaccccgaagacgaccgaaccgtcggaaatcgacctactacgttacttccggagattaacgataccggtaacacgtccgaagggacgtaccggaacccggtagggaacccnccgggtattcggtttaaaccgtttaagttcgggttagggtacggggggtaattacggggtaagtttacgggggg

SEQ ID NO: 144382 - DNA, 659 bp, Homo sapiens
  misc_feature: GYAE6OF01A32RR.33.57.F02.1.454.CMB.1.raw
  modified_base (554)..(554): a, c, t, g, unknown or other
  misc_feature (554)..(554): n is a, c, g, or t
tcagtacacacactcacgaccggtgctcgatttagctcgatatagtgagctctgggagaagagccccagccccagaattcccaggagtttccattcggtgatcagcactgaacacagaggactcaccatgggagtttgggctgagcttgggttttccttgttacaattataaaaggtgtccagtgtcaggtgcaacgtgggtggagtcgtgggggacgacctgggtcaagccgtgggacgggtccctgagacctctcctgtcgcaggccgcgtggacttcagtcttcagtcgactactacagtgggctgggactcccggacgacggccgtaccggaagggggaacggggcgtaggggaggttgggtattttcgatttcgtaagtttaagttaacgttcgttacttcgacctccccgagtaccgtaccctaacgttacgtaaattacgtagacgtaagtaacttcgtaggtacggacggtacgggtacccgtacgttcccgtaccgtcctaccgaaggacgaaccgaccggccgagactctactacttagttccngtacagtacgtacgacacggccgtaggacggacggaccggaacggaccgacggtcttagtacttaagttggttagggtaggggaggttagggtaggtttacgggg

SEQ ID NO: 144383 - DNA, 710 bp, Homo sapiens
  misc_feature: GYAE6OF01ER5PR.33.57.F02.1.454.CMB.1.raw
  modified_base (277)..(277): a, c, t, g, unknown or other
  misc_feature (277)..(277): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctggagggtccctgagactctcctgtgcagccgctggattcagtcttcagtnactactacagtgggctggactccgacgaggcctaccggaggggagggctgggagtggtatttcattcattagtatcgtcttgctcccagtacgtcctacgttaagaattatcgactaagtaacttcgttaggtacggaaggtaccgggtacccttaacgttcccgacccggtttactacccgaaacggtaaccgtaaacccgaaacccgggtcccggaaaggtaccggtcccttaactaaccgttttaacgttttccgacgggtacctaaacggttagtaaccggtaaaccgacggtacccgtaggaaaccgggtaccgggaccccgggtaaggggtaaccccgtacgggttcctttaggttaaccgtttaaggtttacgggtttacgggggttaagggggtaacgggtttagggtaaaacgggtttcggggg

SEQ ID NO: 144384 - DNA, 871 bp, Homo sapiens
  misc_feature: GYAE6OF01E17HS.33.57.F02.1.454.CMB.1.raw
tcagtacacacactcacgaccggtgctcgatttagctcgatatagtggaacgctcgtaccgggagaagacgccccagtccccagtaacttccccagggacgtttacccatttcgggtgtacctcgagccgacccgtagaaactacgaggtaggacctccaaccgagtcgggaaggtttcgggcccttggacgtccgtttggggtttttcccttacggttaaacggaaattaacgtaaaaacggtccgttccctacggtggtccgaaggggttcgacgtaaccgtggggtacgggtaacgttaccggtacgggggggtaactacccgttgggtccgtaaaggtcccgtagggaccgggtccctaggacgtacctccgtccgtcgtcgcgacgcccgtcgtggtactttcgacgtccttaccgacggtcgacctactacgacgtcggcctagggactcccggtacgacgggtccgtaccggaagggggtacgggggtcttagggggacgtaggttaacctttcgaacgtttcctaacgttaacgtaacgttcgttacgtcgtaccttacccggtaaggtaccggttaccctaaaggttaaggtaaactttgacggtaactagttaacttcggtaggtacgaggaccggtacgtacttaccgaccgtcctaccgaaggtaccggaaccggtacccggtaccgaaggtaaccggtcccgttaaacgtacgtttaaaccgttccgaacgggtactacggtagtaccgaaaccgtgacccgttaggtaccgaccgggtaccgtacggtaacccgtccgggtctcgtttaaccttaggtttacgggcggttaggggtacggttcgttaagggtcgggg

SEQ ID NO: 144385 - DNA, 636 bp, Homo sapiens
  misc_feature: GYAE6OF01AB9QV.33.57.F02.1.454.CMB.1.raw
  modified_base (215)..(215): a, c, t, g, unknown or other
  misc_feature (215)..(215): n is a, c, g, or t
tcagtacacacactcacgaccggtgctcgatttagctcgatatagtgagctctgggagaagagccccagccccagaattcccaggagtttccattcggtgatcagcactgaacacagaggactcaccatgggagtttgggctgagctgggttttccttgttacaattataaaaggtgtccagtgtcaggtgcaactggtggagtcgtgggggganaccgtggtcaagcctgggagggtccctgagactctcctgtgcagccgctggattcagtcttcagtgactactacagtgggctggactccgacaggctccgaggggagggctgggagtggtattcattcattagtatcgtcttgcctcccgagtacgtccacttagaatatgacagaatcgtgtgagacggtccgtattccgacccgttctacccaaggtacgaaccgaacggccgaagacgtcctctaacgttactttccgagtacctaaggtactacggaaaccgtacggtcccgtagggaaacggacgggtaacccgggaacggggtaccggaacccggggttccttagggttaacctttaacggttttacggttacggggtaaggggggtagggttacggggtaaaggtttcgggggg

SEQ ID NO: 144386 - DNA, 508 bp, Homo sapiens
  misc_feature: GYAE6OF01A6TIC.33.57.F02.1.454.CMB.1.raw
  modified_base (221)..(221): a, c, t, g, unknown or other
  misc_feature (221)..(221): n is a, c, g, or t
  modified_base (308)..(308): a, c, t, g, unknown or other
  misc_feature (308)..(308): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtctggggganacctggtcaagcctggagggtccctgagactctcctgtgcagccgctggattcagcttcagtgactactacatgggctggatccganaggctccgagggagggctgggagtggatttcattcattagtaatcgtctgctccagctccattagatntncagtatctgtgagagccgattcaccgtctacagacgacaacgccgagacgctcacttattcgngacagatagaacngccgtgagcgccgaggaccncggctgtactattagttaggngggtggtggtaag

SEQ ID NO: 144387 - DNA, 843 bp, Homo sapiens
  misc_feature: GYAE6OF01A409Y.33.57.F02.1.454.CMB.1.raw
  modified_base (176)..(176): a, c, t, g, unknown or other
  misc_feature (176)..(176): n is a, c, g, or t
  modified_base (213)..(213): a, c, t, g, unknown or other
  misc_feature (213)..(213): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtntccagtgtcaggtgcaactggtggagtcgtggggganaccgtggtcaagcctgggagggtccctgagactctcctgtgcaggccgctggatttcgagtcttcgagtgactactacagtggggctggactcccggacacggcgtaccggagggggaacgggtctgggagtggtatttcagttctagtttagtaattcgttcttgccctaccgagtacgtcctaacttagaaattcgtagaccgtaagtaacttcgttagggtacggaacggtacgggtaccccgttaacgtttaccccggaacccggtttccccgttaaccggaaacggtaacgggtaaaccccgaaacccgggtaccccgggaacgtaaaccggttcccccgttttaaacgttaaacccgtttttaccggttttttacccggacgggttaaacccggttaaacgggtaaccggttaaacggaaacccgtacccggggtacccccggttaaaggggaaccggggaaaaccccggggtaccccggggtaaaccgggggtaacccgtaacccgggggtccgttttaaccgggttaaaccgtttttaaaggtttttacggggtttacggggggtaacgggggggtttaaaaggggtttaaccgggggttaaaggttttaaccggggggggg

SEQ ID NO: 144388 - DNA, 757 bp, Homo sapiens
  misc_feature: GYAE6OF01CIGIP.33.57.F02.1.454.CMB.1.raw
tcagtacacacactcacgaccggtgctcgatttagctcgatatagggtgagctctgggagaagagccccagccccagaattcccaggagtttccattcggtgatcagcactgaacacagagactcaccatggagtttggctgagcgttggttttccttgttacaattaataaaggtgtccagtgtcaggtgcaacgtggtggagtcgtgggggactaccgtgggtacaaggtccgtgggacggtccctgacgactctccgtgtcgcgacgccgtgtggacttcgagtccttacgagttacgaccttactacgagtcggggactcgggactcccggacacggtccctaccggagggggtaacggccgtagggacggttacggttactttaccgtacgtttagtaacgttttaaaggtacgttccggtttctccggtccctacccgaaggttaccgttacccgttaaactttaaggaacttcggttacgaacgttaaggtaacttcggttagtaaggacggtaccggtaccgttaacgttaccgtacccgttccgtaaccaaggaacgaaccgaccgtacccgagtacgtacctacgtacctttagttaccgacgacctaagtactaacgtaaccgaccgtacggttaaggaaccgacgggaacccggtaaccgggaacgtaccgggtcgtttacggttactttaacggtttacgggttacggtaaggggttacgggttaagggtaaccggtttggggg

SEQ ID NO: 144389 - DNA, 588 bp, Homo sapiens
  misc_feature: GYAE6OF01AQ7DB.33.57.F02.1.454.CMB.1.raw
  modified_base (214)..(214): a, c, t, g, unknown or other
  misc_feature (214)..(214): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtccagtgtcaggtgcaactggtggagtcgtggggganacctggtcaagcctgggagggtccctgagactctcctgtcgcagccgctggattcagtcttcagtgactactacagtgggctgggactccgacgaggcctcgaggggaaggggctgggagtggtatttcagttcatttagtaattcgtcttcgcctccaggtactacctactaagtaatatgacagtaattcgtgtagaggacggaccgtacttcacccggtctaccgaagacgaacgacgaccggagacgactcctaagtttcttctgtacagtacgtacgaacagtccgtagacggtaccgaccggtacggaacccgacggtcgttagtacgttaagttggttgggtagggtagggtagggtaggttacggg

SEQ ID NO: 144390 - DNA, 593 bp, Homo sapiens
  misc_feature: GYAE6OF01D8TJV.33.57.F02.1.454.CMB.1.raw
  modified_base (488)..(488): a, c, t, g, unknown or other
  misc_feature (488)..(488): n is a, c, g, or t
  modified_base (501)..(501): a, c, t, g, unknown or other
  misc_feature (501)..(501): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggggagacctgggtcaagcctggagggtccctgagactctcctgtgcacgccgctggattcgagcttcagtgactactacagtgggctggactccggaacgacgggctccggaggggaaggggctgggagtggtatttcgattcatttagtaacttcgtcttcgcctcccaggtacgtcctacgttagaatatcgactagtaatcgttggtagaggacggtccctagttccacccgtctaccgagacgaaccaaccgccgagacgcctacacttacttcngacagatcgaacncgccgtaggacggacggtacccggaggaccacggtcttacgttcttaaacgtttggttacgggtagggggtaaggttggaaggtttacgggg

SEQ ID NO: 144391 - DNA, 720 bp, Homo sapiens
  misc_feature: GYAE6OF01CSZNK.33.57.F02.1.454.CMB.1.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (392)..(392): a, c, t, g, unknown or other
  misc_feature (392)..(392): n is a, c, g, or t
  modified_base (704)..(704): a, c, t, g, unknown or other
  misc_feature (704)..(704): n is a, c, g, or t
tcagtacacacactcacgaccggtgctcgatttagctcgatatagtgagctctgggagaagagccccagccccagaattcccaggagtttccattcggtgatcagcactgaacacagaggactcacatggagttgggctgagtcgttgggttttcctagttacaattaagtaaaagtgtccagtgcagggtncaacgtgggtggaacgtcggtgggggganaccgttgggacaaaggccgtagggacggggttccctggaggaccttcctccgttggacggcacggtccggcgtaggtaatttccaaggtctttacgagttacgaacttaactaacgtaagtcggggacgtagggaactcccgaacgaggtccaccgggaggggaacggggntagggaagtggtactttacattataagttaacgtaagtccgtttacttcgacctaacccgagtaaccgtaccctaagtttaaagtagtaactagactaagtaacctgtgtaaggacgaacggtccgtaattacccgaaccggtttacacggaaacgtaacggaacccaacggggtacccaagggaattcccgttacaaacggtttactttcgaacggactaagtataaccggaactacggactaggacggtacgccgggaaacgtacgcggttatacggttataagtttaggtaggggaacgggtttacggngggttaagttaggggg

SEQ ID NO: 144392 - DNA, 607 bp, Homo sapiens
  misc_feature: GYAE6OF01AUYCG.33.57.F02.1.454.CMB.1.raw
  modified_base (213)..(213): a, c, t, g, unknown or other
  misc_feature (213)..(213): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggganacctggtcaagcctggagggtccctgagactctcctgtgcagccgctggattcagtcttcgagtgacctactacagtgggctggactccgacgaggcctcggaggggagggctgggacgtggtattcattcattaagtatcgtcttcgcctacccgagtacgtcctaacgttagaatatcgactaagtaactcgtggtagaggacggtccgtaattcccgaccgttcacaaggtaccgaaccaaccggcggagacgtcctactaactttatttccgagactaagtntacgaacncgtactaggagacccggtccggaaggtacccgacgggtcttacggttaacttaggtttacggtacggggtaaggggtacgggttaaggtcggttacgggg

SEQ ID NO: 144393 - DNA, 644 bp, Homo sapiens
  misc_feature: GYAE6OF01A2SZA.33.57.F02.1.454.CMB.1.raw
  modified_base (318)..(318): a, c, t, g, unknown or other
  misc_feature (318)..(318): n is a, c, g, or t
tcagtacacacactcacgaccggtgctcgatttagctcgatatagtggagctctgggagaagagccccagccccgagaattcccaggacgtttccattcggtgatcagcactgaacacagaggactcacatggagtttgggctgagctgggttttccttgttacaattataaaaggtgtccagtgtcagggtgcaacgtggtcggagtcgtggggggagaccgtggtcaagcctggagggtccctgagactctcctgtcgcagccgctgggacttcgacgccttcgagttcgactactacatgggctggactccgacnggctccgagggaagggctgggagtgggtatttcgattcagtttagtaatcgtcttgccttcccagtacgtcccaacttaagaataacgtgacaagaacttcgtaggtacgaagcgggtacccgttaattccgtaacccgttctaccgaacggaacgaaccaaccggccgaagtacggtccttaccgaactttaacgttttccgacgggtaccgaagtaactcggaaactccggtactacggaacggacggtacccggagggacccacgggtctacgtactttaatttacggttgggtaggggttacgttgggtaacgtttacgggg

SEQ ID NO: 144394 - DNA, 658 bp, Homo sapiens
  misc_feature: GYAE6OF01CL43F.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctgggagggtccctgagactctcctgtgcagccgctggattcgagtcttcgagtgactactacagtggggctggactccgacaggctaccgagggagggctgggagtggatttcattcattagtaactcgtctgcctccagacgtcctaacttagaatatgacaagtaacttcgttggtacggaggtacggtacccgtatttacccgaccggttcctacccgaaggacgaaccgaaaccggtcccgaagtacgcccttaacgtacgtttactttccgacggtactaaggtactaacggaaaccgtcggtacccgtaggaaacggtaacggcccgggtaaacgggaaccctccggggtcctttagggttaccttttaaaggtttacggtttggggtaacggggggtaaggttagggttaaagggtttacggggg

SEQ ID NO: 144395 - DNA, 835 bp, Homo sapiens
  misc_feature: GYAE6OF01DGT30.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatgggagtttgggctgagctgggttttccttgtttctgtcctagaaggtgtccattctgttgtgcagctgggtgggagggtcgggggggaggtcgttacggggtacccgggcccggggggggtcttacgtaaggaccttcctccgttgtgcacggcctccggaatcagtacttccacctagtcctttcggccttcgaccgtcggggtcccgcccgagggccttccgggtagggggaacgggggtcgtaggggtaggtgggtccttggtactaagttacgtcggtcctttcggtgggtaacgggttggtacggttcggggttccgtacggtttcctttccgtaaccggccggtaccttcggtgggtcgggacgggggtcctaattccgaacgtacctacccgtttaccgaacggtaaccgaaacccgaaacccggaaccctaaaacccgtaaccccgttccccgtacggtaccctaacttcccgtaaccgtacgtaacggtaccgggaaaccctaacccggtcgggaccggaacgggaccgggacccgggaaccggaaccgggttaccttaaacgttaacgtttaacgttaccggttacggttaccggaaccgttaaccgtaaccggtttaacccgtttaaacgttacgaccgttaacgggtacgggtttcccggggtttaccggggggtcggggtcccgggtccgggg

SEQ ID NO: 144396 - DNA, 537 bp, Homo sapiens
  misc_feature: GYAE6OF01A0VC9.33.57.F02.1.454.CMB.1.raw
  modified_base (216)..(216): a, c, t, g, unknown or other
  misc_feature (216)..(216): n is a, c, g, or t
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
tcagtacacacactcacgaccggtgctcgatttagctcgatatagtgagctctgggagaagagccccagccccagaattcccaggagtttccatttggtgatcagcactgaacacagaggactcaccatggagtttgggctgagctgggttttccttgttaacaattataaaaggtgtccagtgtcaggtgcaacgtggtggagtcgtgggggganaccgtgggtcaaggcctgggagggtccctggagacctctcctgtgcagccgctggattcagcttcagtgactactacagtgggctggatccgacacggctccgaggggaagggctgggagtggatttcgattcattagaactcgtnttgcctcccagtacgtccactttaagaattagtgacagtaatcgtagtgaggcggccgattcaccgtcnccagacgaccaacgcgaganctcatattcngcagcngaacngctgagacgccgaggacacggcttggtcttagttacgttgggtagggaggttgggtaagttgggg

SEQ ID NO: 144397 - DNA, 675 bp, Homo sapiens
  misc_feature: GYAE6OF01A8XDB.33.57.F02.1.454.CMB.1.raw
  modified_base (295)..(295): a, c, t, g, unknown or other
  misc_feature (295)..(295): n is a, c, g, or t
  modified_base (386)..(386): a, c, t, g, unknown or other
  misc_feature (386)..(386): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtgggggagacctgggtcaagcctggagggtccctgagactctcctgtgcagccgctggattcagccttcagtgactactacagtgggcnggactccggacaggcctcggaggggaagggctgggagtggatttcattcattagtaatcgtcttgcctccgagtacgtccaagttagaatntcgacaagtaacttcgtggtagacggtacgggtacccgtaactttcccgaacccggtcctacccgaaggtaacccgaacccgaaaccgggccccgtaaaggaccgtaccttaccgtaacctttaacttttccgacgtacctaagtaacgtacgaaacgtaccggtaccgtaggaaccggaacgggaccccgggaaagggaacccgtaccgggccgtttacgtaacctttaggttttaaccggttaggggttaggggggtaacgggttaggggttaaacgggtttggggg

SEQ ID NO: 144398 - DNA, 569 bp, Homo sapiens
  misc_feature: GYAE6OF01DIEXW.33.57.F02.1.454.CMB.1.raw
  modified_base (302)..(302): a, c, t, g, unknown or other
  misc_feature (302)..(302): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (483)..(483): a, c, t, g, unknown or other
  misc_feature (483)..(483): n is a, c, g, or t
  modified_base (495)..(495): a, c, t, g, unknown or other
  misc_feature (495)..(495): n is a, c, g, or t
  modified_base (533)..(533): a, c, t, g, unknown or other
  misc_feature (533)..(533): n is a, c, g, or t
  modified_base (557)..(557): a, c, t, g, unknown or other
  misc_feature (557)..(557): n is a, c, g, or t
tcagtacacacactcacgaccggtgctcgatttagctcgatatagtgagctctgggagaagagccccagccccagaattcccaggagtttccattcggtgatcagcactgaacacagaggactcaccatgggagtttgggctgagctgggttttccttgtttctgtcctagaggtgtccattctgttgtgcagctggtggaggtcggggggaggcgttgggtaccggccgggggggtctcgtaagactctcctgtgcagcctccggaatcagattcacagtctttggccttcacgtggtccnccgaggctccgtggggagggcgtggagtggctgtcatagtgcttgtgggagtgtagtgggtcgtcgttcttcgtacggcggtactcgtggtggacggggccattcgacgtcaccgttccagagaccaacgaccaaacaccctccngaccatcncagactggaccaacctgaccgagaccgnggtaccacggtntataattatactggtacgaccgtaacacgtactttaanagacgtaagagtccgggtcggggngggtcgtcgggg

SEQ ID NO: 144399 - DNA, 547 bp, Homo sapiens
  misc_feature: GYAE6OF01B8Q6M.33.57.F02.1.454.CMB.1.raw
  modified_base (352)..(352): a, c, t, g, unknown or other
  misc_feature (352)..(352): n is a, c, g, or t
  modified_base (457)..(457): a, c, t, g, unknown or other
  misc_feature (457)..(457): n is a, c, g, or t
  modified_base (471)..(471): a, c, t, g, unknown or other
  misc_feature (471)..(471): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctggagggtccctgagactctcctgtgcacgccgctggattcagcttcagtgactactacagtggctggatccggacaggcctccgaaggggagggctggagtggtatttcattcattagtaatcgtnttgctcccgagacgtccactttaagaacttatgacgagaactcgtgtgaggacggtcctattcaccgtctccgagacgacgacgcgagacgactctacttattcngacagagtagaacngcctagacgacgcggacggacgacggtcttcgtacttagtttagtgggtagggtaggttcgggtaaggttacgggg

SEQ ID NO: 144400 - DNA, 632 bp, Homo sapiens
  misc_feature: GYAE6OF01EC3QM.33.57.F02.1.454.CMB.1.raw
  modified_base (265)..(265): a, c, t, g, unknown or other
  misc_feature (265)..(265): n is a, c, g, or t
  modified_base (371)..(371): a, c, t, g, unknown or other
  misc_feature (371)..(371): n is a, c, g, or t
tcagtacacacactcacgaccggtgctcgatttagctcgatatagtgagctctgggagaagagccccagccccagaattcccaggagtttccattcggtgatcagcactgaacacagaggactcaccatgggagtttgggctgagctgggttttccttgttacaattataaaaggtgtccagtgtcaggtgcaactgggtggagtcgtggggggagaccgtggtcaagcctgggacgggtccctgagactctcctgtgcagccgntggattcagtcttcgagtgactactacagtgggctggacgtccgacgacggccgtaccggaggggaacggggctagggaggtggtcgtgtcatagtcgtcttcggngggtaggtgagttcggtcgtcgttcgttcgtacggcgtacttcggtggtgggacggggtcctagttccgagtcctaccgttccgaagaccgaaccgaaccgacccaaactacctccccgtagacctactccgaaccagtacgtacggaaccctacgtggaccgacggaccggaccggaacgaccggtacttaacgttatttaaccgtacgtcggtacgaccgaaacgtacttaacccgttaagacgcgtaggttacccggg

SEQ ID NO: 144401 - DNA, 729 bp, Homo sapiens
  misc_feature: GYAE6OF01AZX91.33.57.F02.1.454.CMB.1.raw
  modified_base (607)..(607): a, c, t, g, unknown or other
  misc_feature (607)..(607): n is a, c, g, or t
  modified_base (659)..(659): a, c, t, g, unknown or other
  misc_feature (659)..(659): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagttggctgagtcttggttttccttgttacaattagtaaaaggtgtcctagtgtcgaggtgactaacgtggtggacggttcggtgggggacgtaccgtggtacgaacggccgtagggtaccgggttccctggacgtacctccgtcgtgtcgacgacgtccgtcgtggtacttcgacgtcttcgacgtctacctaccgtacagtcgggtctggacgtcccgacgtacggtccgtaccgggaggggacgggtctgggagttacgtactttcgtattacgtaagttaacgtacgttccgttacgttcgcctacccgaagtccgttaccctaattacgaattcgtacgactaagtaacttcgtgaggacggtacggacctacgtacccgaccgttaccacgaaagtaccgaaccgaacggcccgtagaccctacgttacctacgtttacgttccgagtacctagtaactacggtaaaccncggttacgacgggaaacgtacccggggacccgaacgggaccgacccgggttnttacggtttacctttaaggtttaggggttaggttaggggggtaagttacggggttaaaggtttcgggggg

SEQ ID NO: 144402 - DNA, 709 bp, Homo sapiens
  misc_feature: GYAE6OF01B46JF.33.57.F02.1.454.CMB.1.raw
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggttttccttgttacaattataaaaggtgtccagtgtcaggtgcaacgtggtggagtcgtgggggagaccgtggtcaagccgtggacgggtccctgagacctctccgtgtgcgagccgctaggtacttcgagtccttcagtgacctactacagtcgggctaggactaccggacacggcctaccggaggggaacggggcgtagggaggtggtatttcgagttcaatttagtaactcgttacgttcgaccttccgagtacgtaccctagttaagaattacgtacgacaaggtaacttcgttaggtacggaacgtacgggtccctaagtttcccgacccgttcgtacccgaaaggtaccgaacccaacccgggtccggaagggacctaccctacttaaccgtttacgtttacgacgacgtaaggtactaaggaccctaacggtccgtaagggaaaccggtacgggtcccggaaacgggtaccgacccgggttacttacggttttacccgttaagttttacgggttggggtaacgggggtaagggttgggtaaagg

SEQ ID NO: 144403 - DNA, 727 bp, Homo sapiens
  misc_feature: GYAE6OF01AVALR.33.57.F02.1.454.CMB.1.raw
  modified_base (628)..(628): a, c, t, g, unknown or other
  misc_feature (628)..(628): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagtcgttgggttttccttgttactaattaataaaaggtgtccagttgtcgaggtgacaacgtgggtggagtcggtggggggacgaccgtggtacaaggccgtgggacgggtccctggagaccttctcctggtcgcacgccgcgtggtattcgagtccttcgagttacgtactaacctagtaggtgggcttagggtaccgtccggacgtacggccgtaccgggaaggggggtacgggtcgtaggggtagttacgggttacttttacgagtttactaagtttaacgttaacgtttccgttacgttacgtacccgtacccgaacggtacggttacctaacgtttaagaatagtcgacgtagtaacttggtaggttacggagggtaccggtaccgttacttcccgaacccgttcaccggacggaacgaaccgaaccgcggaacgcctcctaacttacgttacttcgagtacctaaggtactacgaaccgngtaccgtaggacgaccgggacggacggtaccggacggttcttaggtaccttttaagttcgggttagggaggggtacggttaggggtaaggtttacgggg

SEQ ID NO: 144404 - DNA, 683 bp, Homo sapiens
  misc_feature: GYAE6OF01C83GE.33.57.F02.1.454.CMB.1.raw
  modified_base (524)..(524): a, c, t, g, unknown or other
  misc_feature (524)..(524): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggaggtttgggctgagtcttgggtttttccttgttaacaattaataaaaggtgtccagtgtcaggtgcaacgtgggtggagtcgtgggggagaccgtggtacaagccgtgggacgggtccctgacgactctcctgtgcgacgccgcgtggattcgagtcttcagtacactactacagtggcgtcggactccgacgaggccgtaccgggaggggacgggtcgtagggtacggttggtactttacgtattacgtaatttagtaacgttcgttacttcgtccgtaccgagtacttaccctagtttaaacgaattagtacgacgtagtaacttcgtgtaggaggtacgaccgttactcctaaccgtcctaccgaacggacgaaccgaccggacggaacncgtccttacgtaactttacttcgacgtacaagtacgtacgaacgtacgtccgtaaggaccggacgggtaacccgggaacgtaaccgtccgggtacgtttgtttaaaccgttgttttaacgggtgggttaggggtaagggtgggtttaaggttacggggg

SEQ ID NO: 144405 - DNA, 688 bp, Homo sapiens
  misc_feature: GYAE6OF01D931K.33.57.F02.1.454.CMB.1.raw
  modified_base (327)..(327): a, c, t, g, unknown or other
  misc_feature (327)..(327): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagttggggctgtgcttgggttttccttgtttctgtcctagaggtgtctattctgttgtgcagcgtgggtgggaggtcggggggagtcgttgggtacccgggccgggggggtctcgtaagacctctccgtgtgcacgccgtacggaatcgagacttccaaccacgtcgtttcggcccttcgaccgtcggggtccccnccgacgggtccttccggtggggggaacggggtccgtaggggtaggtcgggtcgtcgtcgtaattagtcgtcgtttcggtgggagggtgagtcgggtcgcgttcttcgtacggccggtactcggtggtcggacggggtcctattcgacgtcctacccgtacgaggaaacgtacccaaccgtacccaaacgtacccctcccgttagcctacctcccgtacccaaggtacgaccggaacctaccggtcgaccggaacgacccgggaccggaaccgacggtactaagttaattacgttagtggacgtaccgatacggtaccttaagacggacgtggtacgtccggggtcgggtgtcccggtccgg

SEQ ID NO: 144406 - DNA, 765 bp, Homo sapiens
  misc_feature: GYAE6OF01AQUVN.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcgtgggttttccttgttacaattataaaaggtgtccagtgtcaggtgcaacgtggtggagtcgtgggggacgaccgtggtcaagccgtgggacgggtccctgacgactcctcctgtcgcgagccgctggattcgagtcttcagtcgactacgacagtgggctaggactccgacgaggccgtaccggaagggggaacggggcgtagggaacggttagggtactttccgtaatttacgtaagtttaaggtaacttcgtcctttggcccttcccgaagtacgttaccctaacgtttaagaaaacttacgtacgtacgtaaacggttaacttcggttagggtaggaaaccgggtacggggtaacccccgtttaactttaccccggaaaccccggtttctaaccccgggaaaggaccggaaacccgtaacccgggacggaaggaaccgtcctaaccgttacctttaagtttccgaggaccgttaaataggtacgaaacccgtcgtaccggtagaaccgggacgggtacccgaaacgggtaccggtaaccggggtcttaccgggtttacttaaggttttacggtacggggttaagggggacgggttaaggggttaacgttacggggg

SEQ ID NO: 144407 - DNA, 734 bp, Homo sapiens
  misc_feature: GYAE6OF01C1XW3.33.57.F02.1.454.CMB.1.raw
  modified_base (178)..(178): a, c, t, g, unknown or other
  misc_feature (178)..(178): n is a, c, g, or t
tcagtacacacactcacgaccggtgctcgatttagctcgatatagtgagctctgggagaagacgccccagccccagaattcccaggagtttccattcggtgatcagcactgaacacagaggactcaccatggagtttgggctgagcttgggttttccttgttacaattataaaaggtntccagtgtcgaggtgcaagtgggtggaggtcgtgggggacaccgtggtcaaggccgtagggacgggttccctaggacgtaccttctccgttggtcgcgacggccgtacgtggtacttcgacgtcttacgagtacgacctatacgaggtggtcctggacctccgaacgcggtccgtaccgggaaggggaacgggtcgtagggtacggtggtactttacgtagtactttaagttaacgtaacgttcgtcgttacgcccttacccgaaggtcttaacccgtaattaaacggaattacgtagtacgaagttagtccgttaggtagggtaacgacggtacgtaccgttaccgtaccgtcctaaccgagaacggaacccgaaccggtccgaagtacgaccttaaccttacgtttaaccttcgtacggaactaacggacttaacgaaccgtaccggtacgaaggaaccgggaacccggtacggaaccggacccgaggttcccgttaaccgttagttaacgttagggttgggtaacggggtggtaagggttaagggtttacggg

SEQ ID NO: 144408 - DNA, 606 bp, Homo sapiens
  misc_feature: GYAE6OF01AW58B.33.57.F02.1.454.CMB.1.raw
  modified_base (417)..(417): a, c, t, g, unknown or other
  misc_feature (417)..(417): n is a, c, g, or t
  modified_base (487)..(487): a, c, t, g, unknown or other
  misc_feature (487)..(487): n is a, c, g, or t
  modified_base (521)..(521): a, c, t, g, unknown or other
  misc_feature (521)..(521): n is a, c, g, or t
  modified_base (589)..(589): a, c, t, g, unknown or other
  misc_feature (589)..(589): n is a, c, g, or t
tcagtacacacactcacgaccggtgctcgatttagctcgatatagtggtaggctctgggagaagagccccagccccagaacttcccaggagtttccattcggtgatcagcactgaaccacgagaggactcaccatggagtttgggctgagcgtgggttttccttgttacaattataaaggtgtccagtgtcaggtgcaacgtggtggagtcgtggggagcctggtcaagcctggagggtccctgagactctcctgtgcagccgctggattccagtcttcagtgactactacagtgggctggactccgacgcggccgtaccggaggggaacgggtctagggacgttggtactttcgagtttcgagttaagtaacgttcgttacttcgccgtccgaggtacgtccctaacgttagaatntcgactaagtactcgtaggacgacggacggccgtagttccgaccgttcacgagacgacaacggcgtagcnctacactttattcgagctaagacttacggaaccncggtcctaggaacggccggaccggaggaaccacggtacgttgtacgttaagtttcggtaggggagggnggttaggagtttcgggg

SEQ ID NO: 144409 - DNA, 584 bp, Homo sapiens
  misc_feature: GYAE6OF01E1L1P.33.57.F02.1.454.CMB.1.raw
  modified_base (262)..(262): a, c, t, g, unknown or other
  misc_feature (262)..(262): n is a, c, g, or t
  modified_base (355)..(355): a, c, t, g, unknown or other
  misc_feature (355)..(355): n is a, c, g, or t
  modified_base (568)..(568): a, c, t, g, unknown or other
  misc_feature (568)..(568): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaacgtggtggagtcgtggggggagaccgtggtcaagcctggagggtccctgagactctcctgtgcagccgntggattcagtcttcagtgactactacatgggctggactccgagaggctccgaggggagggctgggagtggtattcgattcattagtaatcgtnttcgctccgagtacgtcctaacttagaactagtcgactagtaactcgttaggtggaaggtacggcccgtaattcccgaccgtcctaccgaaggaacgaaccgaaccggccggaagtacgcctactacctttagttcctagactaagatacgaactacgcctaggacgacgccggaacggaccacgggcttggtacttagttagtgggtagggnggttggaagtttgggg

SEQ ID NO: 144410 - DNA, 659 bp, Homo sapiens
  misc_feature: GYAE6OF01CZECP.33.57.F02.1.454.CMB.1.raw
  modified_base (504)..(504): a, c, t, g, unknown or other
  misc_feature (504)..(504): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttggctgagctgggttttccttgttacaattataaaaggtgtccagtgtcaggtgcaactggtggagtcgtgggggagaccgtgggtcaagccgtggacgggtccctgagactctcctgtgcagccgctggattcgagtcttgagttgactactacagtggctggatccgacaggcctccggaggggacgggctagggagtggtattcgattctaagttagtaatcgttcttgcctacccgaggtacgtcctaattagaattagtcgactaagtaactcgtaggtacggacggtaccggtccgttaacttacccgaacccggttccttaacccgaaagggaaccgtaacccggaaacccgtccgggaaanaccggttacccctaacgtaaccttttaacgttttcgaccgactaacggagttaacgaaaccgtcggacgtagggaaccgagggtacccggaggtacgacccgggtttacgttacttaagttacggttgggaggggtacgtagggtagttacgggg

SEQ ID NO: 144411 - DNA, 628 bp, Homo sapiens
  misc_feature: GYAE6OF01AQ1CS.33.57.F02.1.454.CMB.1.raw
  modified_base (442)..(442): a, c, t, g, unknown or other
  misc_feature (442)..(442): n is a, c, g, or t
  modified_base (489)..(489): a, c, t, g, unknown or other
  misc_feature (489)..(489): n is a, c, g, or t
tcagtacacacactcacgaccggtgctcgatttagctcgatatagtgagctctgggagaagagccccagccccagaattccccaggagtttccattcggtgatcagcactgaacacagaggactcaccatggagtttgggctgagctgggttttccttgttacaattataaaaggtgtccagtgtcaggtgcaacgtggtggagtcgtgggggacgacctggtcaagccgtgggagggtcccctgagactctccgtgtgcagccgctggattcagcttcagtgacctatacagtgggactggactcccgacgacggcctccgaagggggaacggggtcgtgggaggtgggtaatttcgaactttactaagtttaagtaacgttcgttcttacgccttaccccgagtacgtccctaacttagaatatgacaagtactcgtagngaaggcggccctatcccgccgtactccgaagtacaccgaccggcganagcctagtaacttagttcccgagaccgtagacttacggaactacggtaccctgggaaccgaccggaccgaacgggtaccgaccggttcttagttacctaagttttcggagggtcggggaaattcggggtattacggggg

SEQ ID NO: 144412 - DNA, 702 bp, Homo sapiens
  misc_feature: GYAE6OF01BJP7D.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagaccgtggtcaagccgtgggacggtccctgagacctctcctgtcgcagccgctggacttcgacgtcttacagtcgacctactactagtcgggctggactcccggagcggccgtaccggagggggacgggtctgggtagtggtatttcattctagtttaagtatcgtctcgcctccgagtcgtaccctaagttagaatacgtagacgaagtacgttcgtaggtaggacggtacggtccccgtaagtttcccgacccgtacctaccgaaacggtaaccgaaacccgtaacccggacccggtaaagtacccgtacccgttactaaccgtttacgtttcccgagccgttaaagttacgtaacgaaccgtcggtacccgtaggaaccggaaccgggtaccgggtaacggaacccggttacgggttcttacggttaactttaagttttacgggttagggtaacgggggtaaggttacgggtaaaggtttcgggggg

SEQ ID NO: 144413 - DNA, 669 bp, Homo sapiens
  misc_feature: GYAE6OF01DUR3Q.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtcgtgggggaggcttggtcaagcctggaggtccctgagactctcctgtgcagcctctggacttccaccttcgagtgtacttctacatgagcgtggactccgccaggcctaccggaggggagggctgggaggttggttacatacgtagttggtagtagtaggtaagaacctataactacgtacgcgaagtctcgtaggtaggaacggggtccgtaattccaacctattcccgtacgaacgggaacaaccgaccaaagtaacctacacgttagtactacgtacgaactaaagtacgaaaccacgtccgtaggaacggacgtacccggataccgggaaacccgtaccggggtacccgttacctttaagtttaccggttaggttacggaaccggtaaagtaacctaaaaaggtttacgttaaacggggttacgggtaaacggttttaaaaccgggggccgttaaaaacccg

SEQ ID NO: 144414 - DNA, 718 bp, Homo sapiens
  misc_feature: GYAE6OF01C34TV.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcacatggagtttgggctgagtcgttgggtttttccttgttactaattaataaaaggtgtccagtgtcaggtgcaagtggtggagtcggtgggggagaccgtggtacaaggccgtagggacgggtcctgacgactcgtcctgtcgcacgccgtgtggacttcgagtcgttacaggtcactactacgtagtcgggctaggactccgacgacggtccgtaccgggaagggggaacgggtcgtagggaaggttggttaactttcgtaagtttctaagtttaagtaacgttccgttcgttcgcccttacccggagtacgttaccctaacgttaaagaacgttgtacgtacaaagttagttcgtaggtacggtagggacggtacccttacgtttacccgaaccgttcctaacccgaaggaaccgaacccggaacccggccggtaagaccgtacctaactaccgtttagtttccgacgtactaaggtactaacggaacgtcggaaccgttgggaacgaccggtaaccggacggtaccggtacgttccgttaggttacttaggttggtacgggtaggggtacggttaggttagggttacgggg

SEQ ID NO: 144415 - DNA, 697 bp, Homo sapiens
  misc_feature: GYAE6OF01BGF1X.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtccagtgtcaggtgcaactggtggagtcgtgggggagacctggtcaagccgtggagggtccctgagactctcctgtgcagccgctggattcagcttcagtgactactacagtgggctggactcccgacgacggcctaccggaggggacgggtctagggagtggtactttcgatttcatttagtattcgtcttgcctcccgagtacgtcctacttaagaattacgtgacctaaggtaacttcggttaggtacgacgggtacggtacccgtaactttccggaaccccgtcttaccgaaggtaccggaaacccaaccgggcccgaaaggttaccgtcccgttaaccgtaaccgttttattttcccgaggtacccgtaaagtacgttaaccggaaccttaccgggcccttaagggaacggacccggaccgggtaacgggaccctacggggtccttagtttacccgtttaaggtttaggttacgggggttaggggtaaggttacggggtaaggttttacgggggg

SEQ ID NO: 144416 - DNA, 691 bp, Homo sapiens
  misc_feature: GYAE6OF01BMT2H.33.57.F02.1.454.CMB.1.raw
  modified_base (176)..(176): a, c, t, g, unknown or other
  misc_feature (176)..(176): n is a, c, g, or t
  modified_base (215)..(215): a, c, t, g, unknown or other
  misc_feature (215)..(215): n is a, c, g, or t
  modified_base (428)..(428): a, c, t, g, unknown or other
  misc_feature (428)..(428): n is a, c, g, or t
  modified_base (600)..(600): a, c, t, g, unknown or other
  misc_feature (600)..(600): n is a, c, g, or t
  modified_base (640)..(640): a, c, t, g, unknown or other
  misc_feature (640)..(640): n is a, c, g, or t
tcagtacacacactcacgaccggtgctcgatttagctcgatatagtggagctctgggagaagagccccagccccagaattcccaggagtttccattcggtgatcagcactgaacacagaggactcaccatggagtttgggctgagcttgggttttccttgtacaattataaaggtntccagtgtcgaggtgcaacgtggtggagtcgtggggganaccgtgggtcaaggccgtgggacgggtccctggacgacctctccgtgtcgccgacggccgtcgtaggtactttcgagtctttacgaaggttcgaaccttacgtacgaggttcggggcttacgggaactcccggaacgacggccgtaccggaagggggtaacgggcgttagggaagttcggtatttcgagtttacagtttaaggtaactcggtnttcgcctcccgaagtcgtaccctagttaagaattgtacgacaagtatcgtaggtagaacggaccgggtacctaagtttcccgaaccgtttcgacccgaaggaccgaacccgtaacggtccgaagactccctaagtaacctttagttcccgagaccaaggttactaggaaccncggtcctagggacgacggacccggtaagaccgtaccggtnttacgttacttgggtttacggtggggtaaggtaggttaggtagggtttggg

SEQ ID NO: 144417 - DNA, 772 bp, Homo sapiens
  misc_feature: GYAE6OF01E58JI.33.57.F02.1.454.CMB.1.raw
  modified_base (643)..(643): a, c, t, g, unknown or other
  misc_feature (643)..(643): n is a, c, g, or t
tcagtacacacactcacgaccggtgctcgatttagctcgatatagtgagctctgggagaagagccccagccccagaattcccaggagtttccattcggtgatcagcactgaacacagagactcaccatggagttgggctgagtcttgggttttccttgttacaattaagtaaaagtcgtccagtgtcaggtgacaacgtgggtgtagtcgtgggggacaccgtggtcaaggccgtgggacggtccctgacgtacctccgtcctggtacgccgtacgcccggtgtaggtacttcgacggtcttacgagttcgaactacgtaccgtagtacggggtcctagggaccttccgaacgtacgggtcctaccgggtaaagggggtaacgggtccgttaggggtacgtacggttattttaccgaagttcccttaagtttaaacgttactccgggttacttacggtaccctacccgtaggtaaccgttaccctaaacgtttaaggaaacttcgtaggacgtaagttacgcgtttagacggtacggaacgggtccttaacgttcccggaccgttccgtaaccgaggtaaccgtaaccgaacggtcccgaagggtactaccgtaactacgttttacgtcggacgtacgttaanacgttaacggaacgcggtacctagggtaaaccggccgtacgggaacggtacctacggggtccttttggtaaccgttaaacggtttgggtttacggggaaagggtaccggtttaaggaagggtttccggg

SEQ ID NO: 144418 - DNA, 850 bp, Homo sapiens
  misc_feature: GYAE6OF01DNJJG.33.57.F02.1.454.CMB.1.raw
  modified_base (179)..(179): a, c, t, g, unknown or other
  misc_feature (179)..(179): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcgttgggttttccttgttacaattaataaaaggtntccagtgtcaggtgcaacgtggtggagtcgtgggggacacctgggtcaagccgtgggacgggtccctggacgtacttcctccgtggtcgacacggccgtcgtacggtactttccgacggtccttacgaggttacgtaaccttaactacgtaaggttcggggcgttacggggaactacccggaacgtacgggtacccgtaccgggaaggggggtaacgggtccgttaggggtacgggttagggttacttttacgtaacgttttaccgtaaagttttaacggttaaacgtttccggtttcttacggtccctttaccggaaggttaccggttaccctaaagtttacggaaattacgtacggtactaaggtaacgttcgtaggtacgggacggtacgggtacccgtaagtttcccgaacccgtttacgacccgaaacggtaaccggtaaacccgaaccgggtaccgaacggtactacccgttaacgttaacctttaacggttttccgacggtaaccgtaacggtacgtaacggtaacccgtacggtacccggttagggaaccgtaacgggacccggaaacgggtacccgtacgggtccgttaaccggtttactttaacggtttaacgggttcggggtaaggggttaacggggtaaggttaagggtttaccggggg

SEQ ID NO: 144419 - DNA, 669 bp, Homo sapiens
  misc_feature: GYAE6OF01A4I6J.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatgggagtttgggctgagcttgggttttccttgttacaattaataaaaggtgtccagtgtcaggtgcaactgggtggagtcggtgggggagaccgtggtcaagcccgtgggacgggtccctgacgacctcctcctgtgcacgccgcgtggtacttcgagtcttcgagtgactactacagtggctggactccgagcggctcggaggggacgggcgtggagtggtatttcattcattagtattcgtcttcggcctcccgagtaccgtcctaagtttaagaaattagtgacgaagtactcgttagggtaggaacggcgggtaccccgtaagttcccgaaccggtttcccacgtaaggaacgtaaccgaaccggccggaagtacctaccgtacttacgttaatttccgcgacctaagtactacggaacgacgtccgtaagggacggaaccgaccgggtaaacggtccggaaccgggttctttacgggtactttaacggttaggttcggggttagggggtaacgggttagggtaaaggtttcggggg

SEQ ID NO: 144420 - DNA, 877 bp, Homo sapiens
  misc_feature: GYAE6OF01A54BV.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtccagtgtcaggtgcaactgggtggagtcgtgggggagaccgtggtcaagcctggagggtccctgagactctcctgtgcacgcgctggattcagcttcagtcgactactacagtcggtctggactccaaacgcggacctccggaagggggaacggggtctagggtagttcggggtactttacgtaattcgtaagtttaacgttaaacgtccgttcttacggcctacccgtaaggtacgtccctaaacgtttaagtaaacttagtcgtaacctaagggtaacttccgttaggtacgggaaacggtacggggtaccccgttaaaccgttttccgaaaccccgggtttcccgtaaccccggaagggtaaacccggtaaaccccggaaaccccgggtaacccgggtaacgggtaaacccgttcccgttaacccgttaacccgttttaaacgttttccccggtaacggtacccggtaaaaggttaaccggtttaacggaaaccccgttaacgggttacccggtaaacgggtaaaccggggtaccccgggaaacccggggttaaaccggggaaccccggtaaaacccgggggtttccgttaacggtttaaacccgtttttaagggttttaaacccggggtttggggggttaaaccggggggttagggggtttaaacgggggttaaagggttttaacccgggggggg

SEQ ID NO: 144421 - DNA, 731 bp, Homo sapiens
  misc_feature: GYAE6OF01BEERW.33.57.F02.1.454.CMB.1.raw
  modified_base (213)..(213): a, c, t, g, unknown or other
  misc_feature (213)..(213): n is a, c, g, or t
  modified_base (626)..(626): a, c, t, g, unknown or other
  misc_feature (626)..(626): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaggtgtccagtgtcaggtgcaacgtggtggagtcgtgggggganacctgggtcaagccgtgggacgggtccctaggagacctctccgtgtcgcaggccgctggacttcgagtctttcgaggtcaacttacctacgtacgtggggcctgggactcccggacacggtctaccggaagggtaacggggctggggagtggtatttccagttacaagtttacgtaactcggttacgttcggacctaccccgtaaggtaccgttaccgtaaacgtttaagaattaacgtgggtaacctaaggtaactttccggtaggttacgggaacggtcgggacccgttaattacccgtaacccggttcgtaacccgaagggtaaccgaacccgtaaccgggaccggaaggtacggtaccttacgtaaccgtttacgtttccgaggtaccaacggtaattacgggaaaccncggtccgtaggaaacgaccggtacgggaacgacccgtacgggtcttacggttacttaacgtttaggtcgggggtaagggtcgggttaaggtaggttttacggggg

SEQ ID NO: 144422 - DNA, 790 bp, Homo sapiens
  misc_feature: GYAE6OF01CUYFI.33.57.F02.1.454.CMB.1.raw
  modified_base (258)..(258): a, c, t, g, unknown or other
  misc_feature (258)..(258): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacattaataaaggtgtccagtgtcaggtgcaacgtggtggagtcgtgggggacacctgggtacaaggccgtgggacggtccctgagacctctcctggcncacgccgctggattcagtcttcagtctactactagagtgggctggactccgacgaggcctaccggaggggacgggcgtagggtagtagtacttacattactagttagttaacgtcgttcttcgcctacccgaagtacgttaccctacgttaagaattacgtacgactaaggtaacctttcggttaggtaacggtaacgggtacccgggtaacccgtttaccttacccgggtaaacccgttcccgtaacccgtaaacgggaacccggaaacccgaaaccggggtacccgtaaacggaaccggttaccccttaacgtaaaccgtttttagttttacccggcggtaaccgtacggttaaacgttaccgaaaccgtcgggtacccgttaaagggaacccggacggggtaaccccgggaaacgggtaaacccgtacccgggtttacgtttaccggtttaaaccgttaacgggtttttagggttaaaccggggggtagggggtaaacgggtttagggtaaaggggttttaacgggggg

SEQ ID NO: 144423 - DNA, 647 bp, Homo sapiens
  misc_feature: GYAE6OF01BVUBW.33.57.F02.1.454.CMB.1.raw
  modified_base (306)..(306): a, c, t, g, unknown or other
  misc_feature (306)..(306): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggggagacctggtcaagcctggagggtccctgagacctctcctgtgcagccgctggattcagtcttcgagtgactactacagtgggctggactccganacggtctaccgaggggagggctgggagtggtattcgattcattagtatcgttcttgcctacccgagtacgtcctatttagaattagtgactaagtaactcgttaggtacgaggtacgggtacccgtattacccgacccggttacctaccgaaggaaccgaccgtaaacccgggacccggaaggtacgccgttacctaactttaacgtttccgtagtaccgtaagtacttaaccggaaacgtcggacccgttaggacggacgggaccggaacggacccggacggtcgttacggtactttaagtttggttggggtaggggagggttagggaggtttacggggg

SEQ ID NO: 144424 - DNA, 696 bp, Homo sapiens
  misc_feature: GYAE6OF01B1TUU.33.57.F02.1.454.CMB.1.raw
  modified_base (262)..(262): a, c, t, g, unknown or other
  misc_feature (262)..(262): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaggtgtccagtgtcaggtgcaactggtggagtcgtgggggagaccgtggtcaagcctggacgggtccctgagactctcctgtgcgagccgntggattcgagtcttcgagtgactactacgagtggctggactccgacgacggcctaccggaggggacgggctgggagtggtatttcatttacaatttagtaacttcgttcttgcctcccgaagtacgttaccctaagtttaagaaacttagtagactaagtaactcgttaggtacgaggtacggtcccgtacttacccgacgtcctccgaagtacgaaccgaccggccgaacgcgaccttactaacgtttacgtttaccgagtaccgaaagtacgtaacgaaaccgtcggtacccgttaaggaaccgggaaccgggacccggtaaacggggtaaccccgtacggggtacctttaggtttaacccgtttaaggttttaacgggtttacgggggtaaagggggttaggggttaagggttaacgggttttacgggggg

SEQ ID NO: 144425 - DNA, 728 bp, Homo sapiens
  misc_feature: GYAE6OF01DWDEO.33.57.F02.1.454.CMB.1.raw
  modified_base (142)..(142): a, c, t, g, unknown or other
  misc_feature (142)..(142): n is a, c, g, or t
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
tcagtacacacactcacgaccggtgctcgatttagctcgatatagtgagctctgggagaagagccccagccccagaattcccaggagtttccattcggtgatcagcactgaacacagagactcaccatggagtttgggctgngcttgggttttccttgttacaattataaaaggtgtccagtgtcaggtgcaacgtggtggagtcgtgggggagaccgtgggtcaagccgtgggacgggtcccctgacgacctcctcctgtgcngccgctggaattcagtcttcgagtcgactaactanagtcggctagggactaccggacgacgggccgtaccggaggggggaaacggggccgttggggtaaggttgggtaacttttacgaacgtttactaagtttaacggttaaagttccgttactttgcccttaccccgaagtaccgttaccctaaagtttaataaagtaagtttcggaaactaacgaactttcgtaggttaacgggaggtaaaacgggtccccttaacgtttacccgaacccgtttacctacccggaagtacccggaaaccgaacccggtccgaacggtacgtaccgtacgtactttaactttcgacgtacagtaactacgaccgagtaccgtaggacgtacggacccggaggaaccgaccggtcttaagttcgtaagtttagtacggggttagggtaaccgggttagggtaagtttacggggg

SEQ ID NO: 144426 - DNA, 673 bp, Homo sapiens
  misc_feature: GYAE6OF01BBSKF.33.57.F02.1.454.CMB.1.raw
  modified_base (281)..(281): a, c, t, g, unknown or other
  misc_feature (281)..(281): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaacgtggtggagtcgtgggggagaccgtggtcaagcctgggagggtccctgagactctcctgtgcagccgctggacttcagtcttcagtnactactagagtggctgggactccgacgacggccgtaccggaggggaacggggtcctggggtacgtagggtacttttacaagttttccgtaatttaaggttaacgttccggtttacttacggccccttacccgaaggttaccgtaccccgttaaattaaacggtaacgttaatcggacgtaagtaactttccgtaggtagaacgggtacggaccgtattccgaaccgttcaccgaaggtaacgacgtaaccgcgaagtcgacctataccttacttcgacgacgtaacgtatcgaacgagtcccgtagaacgtaccggacggtacggacgaccgggtcgttacgttacgttaagttgggttacgggtggggtaacgggtgtaggggttaacggg

SEQ ID NO: 144427 - DNA, 796 bp, Homo sapiens
  misc_feature: GYAE6OF01DNULM.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattaataaaaggtgtccagtgtcaggtagaacgtggtggagtcgtgggggacgaccgtggtacaagtccgtgggacgggtccctgacgtacctccttccgtggtcgccgacgcccgtcgttggactttaccgacggtcctttacgaaggttcgtaaccttaacctacgaggttcggggcttgggaaccgtcccgaacggtacgggccgtaccgggaagggggacggggtcgtagggtacgggttaggtactttcgaacgtttcgtaagtttagtacttccggttcttacgccgtaccgaagtacgtacctaacgtagaaactgtacgactaagtactcgttagtggaacggtcggtccgttaaccttacccgacccggttccacccggtaaagacccggtaaacccgacccggtacgaagtacccgttcccttaattaccgtttaacgtttccgaacggacgtaaggtaccttaacgggaacccgtggaaccgtagggtaaccgcggggtaaccccgggagggtaaacccgttccggggtctttttacgaaaccgtttttagtttaaggggggttccggggtaaaggggtttagggttaaccggttagggggtttttggggtttaacccggg

SEQ ID NO: 144428 - DNA, 791 bp, Homo sapiens
  misc_feature: GYAE6OF01ED84T.33.57.F02.1.454.CMB.1.raw
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (706)..(706): a, c, t, g, unknown or other
  misc_feature (706)..(706): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcgtgggttttccttgttacaattaataaaaggtgtccagtgtcaggtgacaacgtgggtggagtcggtggggggacgtaccgtggtcaaggccctgggacgggtccctagacgactcctctgtgcagccgntggntcagtcttcagtgactactacngtgggtctaggactccggacgtacgggcctaccggagggggacgggtcgtgggaagttggtactttcgtagtttaccgaagtttaacgtaactttcgggttcttacgcccttacccgtaaggtaccgttacctaaaccgtttaaagtaactaagtaccggagtaacgtaacgttcgtagggtaacggaggtacccgggtacccgttacgttaccccgaccggttacccgtacccgaaaggtaccgaaacccgtaaaccgggccggtaaacgcggttacccttaaccggaacctttttaacgtttcccgagtaacggaacgttaactaaccggaaacgtccccgtacggtaagggtaccggaaacccggtacccggggtaaagggtaacccccgaaccggggtttnttaccccggtttaaagtttaacggttttcgggtaacgggggtaggggggtttacgggtttaaggttaaaggggttttaccggggg

SEQ ID NO: 144429 - DNA, 712 bp, Homo sapiens
  misc_feature: GYAE6OF01BIIYM.33.57.F02.1.454.CMB.1.raw
  modified_base (215)..(215): a, c, t, g, unknown or other
  misc_feature (215)..(215): n is a, c, g, or t
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctggagctgggttttccttgttacaattataaaaggtgtccagtgtcaggtgcaacgtggtggagtcgtggggganaccgtgggtccaaggcccgggagggtcccctggagctctccgtgtgcacgccgctggattcagtcttnagtgactactacagtggggctggactccgacgnggcctcggaggggagggctaggggagtggtatttcgaatttcgagtttagtaagttcggtctttcggcctacccgagaaccgttccacgttttaagaaacttagtacgactaaggtaacttcgtaggttacggagggtaaccgggaccgttacgtttacccgaaccccggttcctaccgaacggaccgtaaaccgaacccgtacggacgacggtcccttaccgtactttaaccgtttcgcgacgtaatacgttaacggaacgacgccttaagggacgtacggtaaccccggaagggtacccgaccgggttacgttaccggttacgtttaaagtttacgggtttaggggtacgggggttaaagggttcgggttaaagggtttggggtttaaccgggg

SEQ ID NO: 144430 - DNA, 224 bp, Homo sapiens
  misc_feature: GYAE6OF01ACINO.33.57.F02.1.454.CMB.1.raw
  modified_base (61)..(61): a, c, t, g, unknown or other
  misc_feature (61)..(61): n is a, c, g, or t
  modified_base (167)..(167): a, c, t, g, unknown or other
  misc_feature (167)..(167): n is a, c, g, or t
  modified_base (173)..(174): a, c, t, g, unknown or other
  misc_feature (173)..(174): n is a, c, g, or t
  modified_base (177)..(179): a, c, t, g, unknown or other
  misc_feature (177)..(179): n is a, c, g, or t
  modified_base (182)..(183): a, c, t, g, unknown or other
  misc_feature (182)..(183): n is a, c, g, or t
  modified_base (185)..(224): a, c, t, g, unknown or other
  misc_feature (185)..(224): n is a, c, g, or t
tcagtacacacactcacgaccggtgctcgatttagctcgatatagttgggtttgggggaanaggaagactgacggtcccccaggagttcaggtgctgggcacagcggccctgggctgcctggtcaaggactacttccagtgtgtgtactgagcgggctggcaaggcncatagnntannnatnntnnnnnnnnnnnnnnnnnnnnnnnnnnnnnnnnnnnnnnnn

SEQ ID NO: 144431 - DNA, 802 bp, Homo sapiens
  misc_feature: GYAE6OF01CVS7S.33.57.F02.1.454.CMB.1.raw
tcagtacacacactcacgaccggtgctcgatttagctcgatatagtgagctctgggagaagacgccccagccccagaacttcccaggtagtttccattcggtgatcagcactgaacacagaggactcacatggtagttggctgagtcgttgggttttccttgttacaaattaagtaaaaggtgtccagtgtcgaggtgactaacgtggtggagtcggtggggataccgtggtacaagtccgtgggacgggtccctaggacgtaccttccgtccgtgtcgcgtacgccgtcgtaggtacttcgacgtccttcgaagtccgtaacttaactacgaggtcgggtacgtacggtacctacccggaacgcggggaccctaccggggaaagggggtacgggcgttaaggggaggttacggttaactttcgtaactttaacggttaaatttacggttaaacgttcccgtttacgttaccggccccgtttaacccgaacgggttaaccgttacccgtaaagtttaaaaggaaacttgtacggaacttaaggttaacgttccgtagggtaacgaccgggtaaccgtcccgtttaaactcccggtaaccgtccggtaacgtaacggaaaccggtaacccgaaccggaccgtaacgccgttaacctacgtttaaacctttggtttacccgagacgttaaacgtacgtaacgaccgacgggtacctaggtaccggacgtacggaacggtacgtacgtcgttaacgttactttaggtacgggttagggtagggtaaggtaggttaggttacgggg

SEQ ID NO: 144432 - DNA, 732 bp, Homo sapiens
  misc_feature: GYAE6OF01DJXQI.33.57.F02.1.454.CMB.1.raw
  modified_base (152)..(152): a, c, t, g, unknown or other
  misc_feature (152)..(152): n is a, c, g, or t
  modified_base (298)..(298): a, c, t, g, unknown or other
  misc_feature (298)..(298): n is a, c, g, or t
tcagtacacacactcacgaccggtgctcgatttagctcgatatagtgagctcgtgggagaagacgccccacgccccagaacttcccgaggtagtttccagttcggtgatcagcactgaacacaggagactcacagtgggtagtttggctagngtcgtttagggttttccttgtaactaattaagtaaaggtcgtaccagtgtcaggtgacgagtggtggaggtcggtaggggacaccgtggtacaacggccgtggacgggtcctgacgcgttctccggtgcgacgtacggccgtacgnggtacttcgacgttcgtacaggtacaccttactacgaggtcgggtccgttaggaccttccggacgtccggtaccggtaccgggaagggggtacgggtcgtaagggtggttaggttactttagacttagttaagtttaacgttaccgtcgtttcgtccgtacccgtaccgtaacgttacgttacccgtaaagtttaataaacgttcgtacgtaagtaacgttattccggtaggtacggtaccggtaccggtcccgttaactccggtaccctacgacgaacgtaccgaaccgtaccggagtactacgtccttaacgttcttaacggtcgaacgtacgaaacgttgtaaccgcgaacgtccgaaggaccgacgtaccgggaacgcgtacggttcttacgttataggtcggtaggagggtagtacggtggtttacggg

SEQ ID NO: 144433 - DNA, 980 bp, Homo sapiens
  misc_feature: GYAE6OF01CRSNG.33.57.F02.1.454.CMB.1.raw
  modified_base (185)..(185): a, c, t, g, unknown or other
  misc_feature (185)..(185): n is a, c, g, or t
tcagtacacacactcacgaccggtgctcgatttagctcgatatagtgagctctgggagaagagccccagccccagaacttcccaggagtttccattcggtgatcagcactgaacacagaggactcaccatggtaggtttgggctggagcgttgggtttttccttgttaacaattaataaaaggtntccagtgtcaggtgacaagtgggtggagtcgtgggggagaccgtggtcaagccgtggacgggtccctgacgactctctgtcgcacggccgtgtggattcgagtcttgacgtacgacctaatacgagtcgggctggactccgacgaaggtcctaccggagggggtaacgggcgtagggagttagggtacttttcaatttacgtaacgttttaacggtaaacttcgggtttccgtttaccggaccctttacccggtaaacgtacccggttaacccttaacgtttaaaacggtaaacttacggttaggaacccgtaaagggttaaacttttccgggttaagggggtaaaccggggtaacgggtaaacccgggggttaccccccgtaacggtttttaacccccgggtaacccccgttaacccgttaacccggaaaaacccggggtaccccggggttaaaaacccccgaaacccggggttaacccccgggtaaacgggtaacccccggtttaaaccgtaacccttttaaaaccccggtttttaaccggttttaaccgggttaaccggttaaacccggaaagggttaacggttaaaacccggaaccggttaaccggtaaaccccgggtaacgggttaaaccgggacccccgggggttaaaccggaaaaccgggggtaaccccgtacgggggggtttaaccctttaaccggggtttaacctttaacgggttttacgggtttaggggggttacggggggggttaaaacggtttgggggtaaaaccccggggtttttagggggg

SEQ ID NO: 144434 - DNA, 678 bp, Homo sapiens
  misc_feature: GYAE6OF01BWDAF.33.57.F02.1.454.CMB.1.raw
  modified_base (265)..(265): a, c, t, g, unknown or other
  misc_feature (265)..(265): n is a, c, g, or t
tcagtacacacactcacgaccggtgctcgatttagctcgatatagtggagctctgggagaagagccccagccccagaattcccaggagtttccattcggtgatcagcactgaacacagagggactcaccatggacgtttgggctgagcttgggttttcctgttacattataaaggtgtccagtgtcaggtgcaactggtggagtcgtgggggacaccgtggtctaagccctggacggtccctagagacctctcctgtgcagccgntggattcgagcttcgagtgaactactacagtgggctggactccgacgacggctccggagggacgggctagggacgtggattcgattcgattagattcgttcttgcctcccgaggactacctacttagaattactgacgagtaacgtcgtaggtcggaacgggtacggttaccccgtaagtttaccccgacccggtttaccacccggtaaagtaaccgggttaaccaaaccgggtccccgtaaggtacccgtacccgttacccgtaacgtttaaccgttttccggaacggtacgtaagtaacttacggaaaccgtcgaccggttaggacggaccgtaccggaaggacctaccgggtctttaggtaccttacgtttacgggttcggtacgggggaagttgggtaaaggttcgggg

SEQ ID NO: 144435 - DNA, 674 bp, Homo sapiens
  misc_feature: GYAE6OF01ES0WO.33.57.F02.1.454.CMB.1.raw
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (437)..(437): a, c, t, g, unknown or other
  misc_feature (437)..(437): n is a, c, g, or t
  modified_base (521)..(521): a, c, t, g, unknown or other
  misc_feature (521)..(521): n is a, c, g, or t
tcagtacacacactcacgaccggtgctcgatttagctcgatatagtgagctctgggagaagagccccagccccagaattcccaggagtttccattcggtgatcagcactgaacacagaggactcaccagtggtagtttgggctgagtcgttgggtttttccttgttaactaattaataaaaggttgtcctagtgtcgaggtgacaacgtgggtggaggtcggtgggggacgtaccgtggtacaacggccgtgggacgggttccctggacgtacctcctccgtgtcgacacggccgngttggtacttccgagtcttcgagtcgtaacttactacgtggtcggctggactccgacggtcggcgtacgggaaggggagggcgtaggnggtgtattcattactattagtatcgttctcgcctacgagtctctactagtatntacgactaagtacttggtaggtaggacgtcggtactacgttaccgacgttacccgacgaacgtaaccgaaccgaccgccggaancgttacctacgttacttacgttccgagtacgtaagtactaacgaccgtcggccgtaagggaaccggaccggaccggaggtaacccggcggttacgttacgttatttaaggttacgggttagggtaaggggtaggttaagggtaggttacgggg

SEQ ID NO: 144436 - DNA, 684 bp, Homo sapiens
  misc_feature: GYAE6OF01EC0YN.33.57.F02.1.454.CMB.1.raw
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
  modified_base (639)..(639): a, c, t, g, unknown or other
  misc_feature (639)..(639): n is a, c, g, or t
tcagtacacacactcacgaccggtgctcgatttagctcgatatagtgagctctgggagaagagccccagccccagaattcccaggagtttccattcggtgatcagcactgaacacagagactcacatggagtttgggctgagtcgttgggttttccttgttaacaattaataaaaggtgtccagtgtcgaggtgcaacgtggtggaggtcgtgggggacaccgtggtcaagccgtgggacgggtccctgacgtacctctcctggtgccgacggccgcgtaggtacttcgagtccttacgagttacgacctactacgagtcgggtctggacgtccgacgacgggccgtacgggaaggggacggggtcgtagggacggttggttactttcgtaacttactaagtttaagtaacttccgttcttcgtacccgtaccaaggtaccgtacctaaacgttaacggtaatacgtgacgtaagtaacttcggtaggtacggaacggtaccggtaccgtacttacccgtaccgttaccaccgaagtaacgaacccgtaacggcgtaagcgtcctacgtaccttacttacgcgtanacgtanacgtaacgcgtacgacggacgacggtaccggacggtaccgtacggtnttacgttagttgtttaggtgggtagggtaggttgtgggttacggg

SEQ ID NO: 144437 - DNA, 707 bp, Homo sapiens
  misc_feature: GYAE6OF01DTI61.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagtcgttgggttttccttgttaacaaattaaataaaaaggtgtacctagtgtcgaggtgcaacgtggtggagtcgtgggggactacgtggtcaaggccgtaggacgggtccctggaacgtcctccgtccgtggtcgcgacggaccgtctagggtacttcgagtcttcgagtacgtacctacgtacgagtcgggtcgtaggacctccgacgacggtcccgtaccggaaggggacgggtctagggtagtggtactttcgtacgttacaatttaagtaagtctttacgtcgtcctacccaaggtactaccgtacttaaagaatcgtagaactagaacttgagtaggacggtacggtacccgtattaccgaccgttactaccgaacggaacgtaaccgaacggtacccggagtaacctcgtaactaacgttactttcgacgtacgaagttacaacgtacacgttccgtagacggtaccgacggtaaacggacgtacccgggtcttaacggtattaacggtttagggtacgggttaggggtaacggttaaggggttaaggtttaccgggg

SEQ ID NO: 144438 - DNA, 809 bp, Homo sapiens
  misc_feature: GYAE6OF01AI1MD.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcgttgggttttccttgttaacaattaataaaaggtgtccagtgtcgaggtgactaacgtgggtggaggtcgtggggggacgtacctgggtacaagccgtgggacggtccctggacgtacctcctccgtggtcgcgacggcccggtcgtagggtacttcgacgtccgttacgacggttcgtaaccttacgtaccgtaggtcggggtctagggtactcccggacgacgggtccgtacccgggaagggggaacggggtcgtagggtcggtcggtccgttggtacctaagttcgttcggtccgtttagggtggggtaagggttggtacggttcgggttcccggtaccgtttccgtttacccggtaccgggtccggttacccgttcgggttacggggtaccggggtacgggggtacccgttacgttaccggacccgtacgttacccgttaaccgggaacgtaaacccggaaccgtaaaccccgaacccctaaacccgtaccccgttacccgtcgacccttaccgtcccgtaaccgaaggtaccgaccggtaacccaaccggtgggaccgtaacggacccgggtaccggaccgtaaccggtacttaagttcgttaacgttcggtacgtcgtaaccgtagtacccgttaccgtagacggtgacgtaccgggg

SEQ ID NO: 144439 - DNA, 731 bp, Homo sapiens
  misc_feature: GYAE6OF01CW7J8.33.57.F02.1.454.CMB.1.raw
  modified_base (366)..(366): a, c, t, g, unknown or other
  misc_feature (366)..(366): n is a, c, g, or t
  modified_base (439)..(439): a, c, t, g, unknown or other
  misc_feature (439)..(439): n is a, c, g, or t
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (527)..(527): a, c, t, g, unknown or other
  misc_feature (527)..(527): n is a, c, g, or t
  modified_base (543)..(543): a, c, t, g, unknown or other
  misc_feature (543)..(543): n is a, c, g, or t
  modified_base (563)..(563): a, c, t, g, unknown or other
  misc_feature (563)..(563): n is a, c, g, or t
  modified_base (574)..(574): a, c, t, g, unknown or other
  misc_feature (574)..(574): n is a, c, g, or t
  modified_base (589)..(589): a, c, t, g, unknown or other
  misc_feature (589)..(589): n is a, c, g, or t
tcagtacacacactcacgaccggtgctcgatttagctcgatatagtgagctctgggagaagacgccccacgccccagaacttcccgaggtagtttccagttcggtgatcagcactgaacacgaggaggactcaccagtggtagtttgggctgagtcgtttcgggtttttccttaggttaactaaagttaaagttaaaaagggttcgtaccgaggttgtacgtagggtccgtacgtaacgttgggtggtacggtcgggtagggggacgtaccgttggacgtaacggtccgtagggtaccggtccctaggacgtctcgtccgtgtcgcgtacggccgtgtcgtagttcgacgttacttagtacggtanaacccttaacgtacgacggtgggtcgttacggaccgtaccggaacgaccggccgtaacgggaaggggtacggngtagggtacgtggtattacgtntagtaagttntacgtcgtctctccgtacgatcgtactagtanaagtntcgactagtgtcgtgaggngtacgtacgtgtaccnccgttacacggataaaccgngaacgtacggntaccgacttacgttnttaacgtcgtagacgtaacgtcaacgacgttacgacggtaacgacgggtaacgtacccgggaggtcccgtaacgggtacgttatttaacgggttgtaacgggttggggaaacgggttagggtacgggtttggttaaccgggg

SEQ ID NO: 144440 - DNA, 179 bp, Homo sapiens
  misc_feature: GYAE6OF01BNA7T.33.57.F02.1.454.CMB.1.raw
  modified_base (174)..(179): a, c, t, g, unknown or other
  misc_feature (174)..(179): n is a, c, g, or t
tcagtacacacactcacgaccggtgctcgatttagctcgatatagttgggtttggggggaagaggaagactgacggtcccccaggagttcaggtgctgggcacagcggccctgggctgcctggtcaaggactacttccagtgtgtgtactgagcgggctggcaaggcgcatagnnnnnn

SEQ ID NO: 144441 - DNA, 764 bp, Homo sapiens
  misc_feature: GYAE6OF01A3S9I.33.57.F02.1.454.CMB.1.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (508)..(508): a, c, t, g, unknown or other
  misc_feature (508)..(508): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcttggttttcctgttacaattataaaggtgtccagtgtcaggtgcaactggtggagtcgtggggganacctggtcaagcctggacgggtccctgagacctctcctgngcacgccgntaggacttccagtcctttacaggtcgaccttactaccgagtcgggggtctaggggtactccccggtaacgacggggtccgtaccgggaaggggggaaacgggggtccttagggggtaaggtttagggtaactttttaccgaagttttcctaaaggttttaacgttaaacgttccgtttctttcgggacccttacccccgtaaagggtaccgttaccccgtaaaacgttttaaacgaaattacggttanaccgtaaaggtaacttccggtaggtacgggtagggacggtaccccgtaagtttccgaacccggtttacctacccggtaaggtaaccgtacccaaacggtccccggaaggaccgttcctacgtacgtttaaccttccggtagaactacgtacgttagactaacgggtccctaaggacggacgacccggagggtaccgaacggttcttcgttaacgttagtttacgttggggtaaggtagggttagtcgggttaaggg

SEQ ID NO: 144442 - DNA, 764 bp, Homo sapiens
  misc_feature: GYAE6OF01BMIUW.33.57.F02.1.454.CMB.1.raw
  modified_base (218)..(218): a, c, t, g, unknown or other
  misc_feature (218)..(218): n is a, c, g, or t
tcagtacacacactcacgaccggtgctcgatttagctcgatatagtgagctctgggagaagagccccagccccagaattcccaggagtttccattcggtgatcagcactgaacacagaggactcaccagtggagtttgggctgagcgttgggttttccttgttacaattaagtaaaagtgtccagtgtcaggtgcaacgtggtggagtcgtggggganaccgtggtcaagcctgggacgggtccctgagaccttctccgtgtcgcgacgcccggcgtgggtacttcgagtcctttccgaaggtagtaaccttaacgtaacgtaggtcggggtactagggacctacccggtaaccgacggaccgtacccggaaagggggaaccggggtcgtagggtaggttacgggtaacttttcaacgtttccgtaaagtttaggtaaaccgttcgttacccgtttcgacctaccccgaaggtaccgtacccgtaaacgttaagtaactaacgtcgaacgtaagtaaacgttcgttaggtacggtacggtaacggacccgtaacgttccgtaacccgttaccgtaacccgaaggaacgtaacccgaaccgaccggaacgacgtccgtaacctacgttactttccgagtaccgaagtacaacgtaacacggtacgtacggaacggaccggtaaccggaacggccgtaaccggtccgttacgttagttaaggtttaggttacggggtaggtaacggggtggttaaggttacggggg

SEQ ID NO: 144443 - DNA, 634 bp, Homo sapiens
  misc_feature: GYAE6OF01DRUSF.33.57.F02.1.454.CMB.1.raw
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggtttttccttgttacaattaataaaaggtgtccagtgtcaggtgcaactgggtggagtcgtggggggagaccgtggtcaagccgtggacgggtccctgacgactctcctgtcgcacgccgcgtggatttccgagtcttcagtgtacctactacagtgggctggactccgacgaggccgtccggaggggagggctagggagtggtatttcagtttctaatttaagttactcgttcttcggcctcccgagtacgttaccaacgtttaagaattagtacgactaagtaacgttcgtaggtacgaggacggtcccgttagttccgtacccgtctaccgaagacgtaaccgaacgtcgaacgacgtccgtactaaccttattttcgcgtacagtactagaacncgtacngaggacgacgaacggagaccggtgttacgttacttagtttacggttgggaagggggtacggttgggtaaggtttacggggg

SEQ ID NO: 144444 - DNA, 755 bp, Homo sapiens
  misc_feature: GYAE6OF01BY4CF.33.57.F02.1.454.CMB.1.raw
  modified_base (636)..(636): a, c, t, g, unknown or other
  misc_feature (636)..(636): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagtcttgggttttccttgttacaattataaaggtgtccagtgtcaggtgcaacgtggtggagtcgtagggggataccgtggtacaacgtccgtgggtacgggtccctggacgtaccttccttccgtgtgaccgacggtccgtcgtggtacttccgacgtcgttacgaggtacgtaccttaacgtacgtaggttcgggtcgtacggtaccgtacccggacgacgggtccgtaccgggaagggggacgggtacgtagggtaaggtacggttacttacgtagtttactaagtttaacgttacgttcgttccgttcgtcctaccgtagtacctacctaagtaacgtaatcgtacgtactaaggttaactcgtaggtaggaaccggtaccggtaccttacgttaccccgacggtcccgtacgaaggtaccggaacctaacccgggtagaacgtacgtacctacgtaacgttttctcggattacgaagtacgagtaaccncggtactagggacgtaacccggacggtaagggtaccccgtaacggttcttacgttaacgtttacgttttacggggtagggggtaaggggttacgggttacggttaaggggtttccgggg

SEQ ID NO: 144445 - DNA, 695 bp, Homo sapiens
  misc_feature: GYAE6OF01BQUAX.33.57.F02.1.454.CMB.1.raw
  modified_base (563)..(563): a, c, t, g, unknown or other
  misc_feature (563)..(563): n is a, c, g, or t
  modified_base (644)..(644): a, c, t, g, unknown or other
  misc_feature (644)..(644): n is a, c, g, or t
tcagtacacacactcacgaccggtgctcgatttagctcgatatagtgagctctgggagaagagccccagccccagaattcccaggagtttccattcggtgatcagcactgaacacagaggactcaccatgggagtttgggctgagctgggttttccttgttacaattataaaggtgtccagtgtcaggtgcaacgtggtggagtcgtgggggacgaccgtggtacaagccgtgggacgggtccctgagactcctcctgtcgcagccgcgtggattcgacgtccttcagtgacctactacgtaggtgggctggacttcccggaacgacgggaccgtaccggaaggggggtaacggggtcgtggggtaggttgggttacttttcgaagttttcaagtttaacggtaacttcgttcgtttacggccctttacccgaggtacgttacctaacgtttaaaggaacgttaacgtcgtacaacgggtaattccgttagggtacggtacggtacgggtccccgtaattcccgaaccgtcctaccgaagaaccgacaaccggcgtaacgtcnccgttactaactttcgtttaccgagtacgtagtactacgggaacctacgtccgtaggagaccggccggaacgtagaccgtnttcgttactttagttcgggttagggagggacgggttggacggtttacgggg

SEQ ID NO: 144446 - DNA, 813 bp, Homo sapiens
  misc_feature: GYAE6OF01C5N8P.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttggctgagtcgttgggttttccttgttaactaattaagtaaaaggtgtaccagtgtcaggtgctaacgtgggtggtagtcggtggggggagtaccgtggtacaacggccgtgggtacggtccctaggacgaccttctccgtggtcgctacggccgtcgtggtaacttccgacggtcctttacgaaggttactaaccttacgtaacgtaggttcgggaccgtacgggacctaccgggacgtacgggtcccgtaccgggaaggggggaacgggtcgtagggtacggttaggttactttacgtactttacgtaagtttaacggtaacgtttccggttaccgttcgtacccttacccgtaacgggttaccgttaaccccgtaagtttaacgtaaacgttacgtaaccggtacgtaaacgtaactttccggtacgggttaaacggacgggtaaacccggtacccgttaaccgttacccgtaacccggtcgtaaccgtaaggacccgtaaccgaccgaccggagtaccgtccttaaccgttaacttacgttccgtagacgtagtacgtcgtacgcggttaccgaaggacgtacggtacccgggacgaccggttaccggtgttaccgttaaggttacgttacgggtttagggacggggttaacggtgggttaacgttacgggggg

SEQ ID NO: 144447 - DNA, 781 bp, Homo sapiens
  misc_feature: GYAE6OF01D1YLI.33.57.F02.1.454.CMB.1.raw
  modified_base (199)..(199): a, c, t, g, unknown or other
  misc_feature (199)..(199): n is a, c, g, or t
tcagtacacacactcacgaccggtgctcgatttagctcgatatagttgggtttgggagctctgggagaagagccccagccccagaacttcccgaggagtttccattcggtgatcagcactgaacacagagactcaccatggagtttgggctgagcgttgggttttccttgttacaattaataaaggtgtaccagtgtanaggtcacgacgtggtggagtcgtaggggactacgtggtacaagccgtagggacggtccctagacgtacctcctcgtgtcgcgacgtccgtacgtgtacttccgagtcttagacgtagtactactacgtaggtcggacgttaggactacccggacgtaggccgtacggggaagggacgggtcgtgggtaacgttacggttattcgtaagttactaagtttaacgtactttccgtccgttagcccctaaccggtagttacccggtaccttaagttaacggtattaacgtcggaacctaagttaaccgtcggttaacggtacggaacgggtaacccggttacctaaccttccggtaacccttccgtaacgaacgtaccgaacccggacgaccggaacgtccgtaccttaccggtaatttccgtaacgtcgtaactaacggttacgaaccgtaagtacccgttacgaaacgggtaccggaacccggtaccgggaacggtacccggttacggtaccgttacgtttaaccgggtttagttaacggggtttaggggtaccggggttaaggttcccgggtttaaaggggg

SEQ ID NO: 144448 - DNA, 905 bp, Homo sapiens
  misc_feature: GYAE6OF01D7K8V.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccagtggagtttgggctgagtcgttgggtttttcctttgttaactaattaagttaaaaggttcgtcctaggtgtcgaggtgcgaacgttgggtggagtcgtgggggacaccgtggtacaaggccgtgggacgggtccctaggacgtaccttccgttccgtgtcgccgacggccgtcgttacggtattcgacgtccttcgagttcgtaaccttactaacgtgtcggggcgtggacgttaccggacgacgggtccgtacccgggaagggggaacggggtcgtagggtaacggttggttatttttacccgtaatttttcctaaaagtttttaacgtaacggttttacccgtttcgtttaccggttccccgttttaaccccgaaaggtttacccgggtttaaccccttaaaccgttttaaagggtaaaactttaaccggttagaccgtaaaaacggtttaaaccggttttaccggttagggttaacggtaaacggggtaacccggggtttaaccccgggttaaaccgtttaccccggttaccccggtttaccccgttaaccccggtaacgggtaaacccgggaaacccgtaaccggacccggaacgtaacgtaccgttactaaccgttttacttacccgttagtaccgtaagttaacgtacgtaaaccgtacgtaccggtacggaggaaccggaccggtacggaaccggtacggtccgtttagttaccgtttaaggtttacggttagggttaggggttgggttaagggttaagggtttacgggg

SEQ ID NO: 144449 - DNA, 743 bp, Homo sapiens
  misc_feature: GYAE6OF01E3Y6I.33.57.F02.1.454.CMB.1.raw
tcagtacacacactcacgaccggtgctcgatttagctcgatatagtgagctctgggagaagagccccagccccagaattccccaggagtttccattcggtgatcagcactgaaccacagaggactcaccatggagttgggctgagcttggttttccttgttacaattataaaaggtgtccagtgtacaggtgcgaactgggtggagtcggtgggggactacctggtacaagccgtgggacggtccctgacgcctctccgtgtcgccgacgccgcgtaggtacttcgacgtcttaccgagtacgtacctacgtaacgagtcggcgtaggactcccggagaacggccctaacgggaggggaacgggctagggtacgttggtactttgatttacgtagtttagttaactcgttcgttacgaccctacccagggttacctacccgtaaattagtaactgtacgacaagtactcgtaggtagtaggtaccggaccgttacgtacccgtacccgttaccgtacgaaaggtaaccgtaacccgaaaccgtccggacgtaaccgtcctaaccgttaacctttagtttacccgtagtaacccggtagttaaacgtaccggtaaaccgaccggtacgtacggacggaacccggtaccgggaccgggtaaccggtacggacccgtttacggtttaacttacggttttacgggttcgggttaaggggttaccggtagggttaggtttaacggggg

SEQ ID NO: 144450 - DNA, 776 bp, Homo sapiens
  misc_feature: GYAE6OF01C9Y1E.33.57.F02.1.454.CMB.1.raw
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
tcagtacacacactcacgaccggtgctcgatttagctcgatatagtgagctctgggagaagagccccagccccagaattcccaggagtttccattcggtgatcagcactgaacacagaggactcacagtggtagtttgggctgagtcgttgggttttccttagttaactaattaagtaaaaggtgtaccgtagtgtcgtaggtgacgtaacgtgggtggtacgtcggtagggggaacgaccgttgggtaccgtaacggcccgttagggtacgggttccctaggacggtaccttccgttccggtggtacgcgtaccgccgtacggttggtacttccggaacgttccgttagtacggtactaaccgtaaccgtaacgngggtcgggngtaacggtacctaccgacgtaggccgtacgggaaggggtacggcgtaggtaggtgttacgttctagttactaagtttacgttagttcgttcgtcgacccttacggtacgtaccttaaccgtagtttaaagagttacgtacgacgtaggtacttcggagtacgggtacgaccggtaccgttactaccgtcgactaacgaacgtacaccggtacgacgtacgccttacgtcgttaactttggtaacctagtagaacgtaacgtacggaaccgttaggaccgaacggtacggaaccggtaccggtaaaccggcgttacgggttactttaagttacggtttcggtttaaagggttacggggaggttaacgggttgggttaaacgggttttcgggg

SEQ ID NO: 144451 - DNA, 585 bp, Homo sapiens
  misc_feature: GYAE6OF01AQYKY.33.57.F02.1.454.CMB.1.raw
  modified_base (213)..(213): a, c, t, g, unknown or other
  misc_feature (213)..(213): n is a, c, g, or t
  modified_base (302)..(302): a, c, t, g, unknown or other
  misc_feature (302)..(302): n is a, c, g, or t
  modified_base (479)..(479): a, c, t, g, unknown or other
  misc_feature (479)..(479): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaacgtggtggagtctggggganacctggtcaagcctggagggtccctgagacctctcctgtgcagccgctggattcagtcttcagtgactactacagtggctggatccganaggctccgagggagggctggagtggtattcgattcattatatcgtacttgctccagtacgtcacttagaatatcgacaagtatcgtggtagagacggaccgtattcccaccggttcaccgaggtacgacgaccgcgagacgcctacgtacttattcgtacacgagtactagaaccgngcctaggacggtacgaccgggaacggtaaccgcgggtctacggtttaccgttaagtttacgggtttaggggtaggggttaacgggtggggttaaagtttcgggggg

SEQ ID NO: 144452 - DNA, 772 bp, Homo sapiens
  misc_feature: GYAE6OF01BXXFK.33.57.F02.1.454.CMB.1.raw
  modified_base (654)..(654): a, c, t, g, unknown or other
  misc_feature (654)..(654): n is a, c, g, or t
  modified_base (683)..(683): a, c, t, g, unknown or other
  misc_feature (683)..(683): n is a, c, g, or t
tcagtacacacactcacgaccggtgctcgatttagctcgatatagttgggtttggggagctcgtgggagaagacgccccacgccccaagaacttcccaggtagtttccagttcggtgatcagcactgaacacagaggactcaccagtggtagtttggctgacgtcgtttcggtttttccttagttaactaaatttaagtaaaaggtcgttccgtagtcgtcgtaggtcgacgaacgtgggtacggagtcggtgggggactaccgtggtaacaacgccgttagggacggtcccgtagacgtacctctccgtagtacgccgacgcccgtgtacggtactacgtacgtcttacgtaagtctaaccgtaactacgagggtacggtcgtaggacctaccggaacgcggtaccgtaacgggaaggggtaaggcgttaggtagggtacgttaactttcgtaacgttacgaacgttttaaagtaccgttccgtaacttccgtaaccgacccgtagtaccgtaccttaacgttaaataacgtagtacgtaacgtaaggtaacttacgggtaggtacggtaaacggacgtccgtaacttaccggaccgttctaaccgacgtaacgacccgaagtaccgtaacgacgtcacttaacgttcgttanacgaactacgtaatacgaactaggtaccnggtaaacggacgtaccggaaggaccgtccgttagtaccgtttagttaacggtttcgggtaagggtacggttaaggggtagttaaacggg

SEQ ID NO: 144453 - DNA, 769 bp, Homo sapiens
  misc_feature: GYAE6OF01CZOLH.33.57.F02.1.454.CMB.1.raw
  modified_base (320)..(320): a, c, t, g, unknown or other
  misc_feature (320)..(320): n is a, c, g, or t
  modified_base (634)..(634): a, c, t, g, unknown or other
  misc_feature (634)..(634): n is a, c, g, or t
  modified_base (648)..(648): a, c, t, g, unknown or other
  misc_feature (648)..(648): n is a, c, g, or t
tcagtacacacactcacgaccggtgctcgatttagctcgatatagtgagctctgggagaagagccccagcccccagaattcccaggagtttccattcggtgatcagcactgaacacagagactcacatggtagtttggctgagtcgttcgggtttttccttagttaactaagttaagtaaaggtgtaccagtgtcaggtgactaacgtgggtaggtaggtcgtgggggaactaccgttcggtacgaacggtccggtagggtaccggtccctaggactccttccgtccgtaggtcgcgtaccgccgtgtagtacttaccgngttacctacgtacggtactaaccttacgtaacgtacggtgggtacctaggggtaacctaccggaacgaccggttcccggaaggggaaccggggtagggtcgtaagggtacgtttaggttactttcgtaagtttctaaaagttttacgttaagttccgtttacgtcccgtaccgtaaccccgttaagtaaccgtttaacccgtagtaaaaggttctaaacggttcgaacgttaacgttacttacgggttgacgggtacggacggtacccgtactacgtacccgtactaaccgagtaccgacgaccgacgagtacnctactacttcgttnacgtacagtaactcgaaccgcgtagtacggacggacggaccggtaacggtacggaccttggtacgttacgttacggtttacgggttaggggtaaggtagggttaggttagggtttaacggg

SEQ ID NO: 144454 - DNA, 870 bp, Homo sapiens
  misc_feature: GYAE6OF01DBPPD.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggtaggtttgggctggagtcgttgggtttttcctttagttaactaatttaaagttaaaaagggttgtacctaaggtgttcgtaggtcgacgtaacgttgggtgggacggttcggtagggggacgtaccgtggtacaacggtccggtacgggtacgggtaccctggacgtaccttccgttccgtgtcggccgacggtaccggtcgtggtacttccgacgtcttacgagtacgtaacgttactacgtaggtcgggccgtaggtaccgtaccggaccgcgggtaccgtaccggggaacgggggacggggcggtagggtaggttaggttacgtttacttacgttagttaagtttaacggttaacgttccggtttcttaccggtcccttacccggtaacgtaccgtaacccttaagtttaaaggtaaacttagtacgaacgttaaggtaccttggtaacgggttacggaacggttacccgggtacccttacggtaccctaacccggtttcccaacggtacggtaaacgtaacccggaaacccgggtaccgtaaggacccgtacggttaacttaccgttttaccggttacgtagtaccgtaagaaccgttacggaaacgtcggaccttaagggaccggacgtaacccggggaaactcggggtaccgttacgtttacccggtttaagtttaaagggttcgggtttaagggggtacggggtaaggtttacggggttaaagttcgggggg

SEQ ID NO: 144455 - DNA, 786 bp, Homo sapiens
  misc_feature: GYAE6OF01BUYWL.33.57.F02.1.454.CMB.1.raw
  modified_base (688)..(688): a, c, t, g, unknown or other
  misc_feature (688)..(688): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagcttggttttccttgttacaattaataaaaggtgtccagtgtacgaggtgacaacgtggtggagtcggtagggggacgtaccgttggtacaacgtcccgtgggtaccgggttccccgtaggacgtaccttccgttccgttggtcgccgacggcccggtcgtggtaactttcgacggtctttacgaggttacgtaaccttacgtaccgaggttcgggtctagggtaacctcccggaacgacggtcccgtaccgggaagggggaacggggtccgtagggaggttaggtacttttccgtagtttactaagtttaagttaacgttccgttccgttacgtcccgttacccgtaaggtaccgtttacccctaaagtttaaagaacttaactacggacgtaaagtacgttcggtagggtacggaacgggtaccggtaccgtacgttacccgacccgttcgaccgaagaacccgaaccgacccggccgaacgcgtaccctaccttaacgttcttcgtaagaccgtaaggtactaaccggaacnccgtacgtaaggaacggtaccggacgggtaacggaccgtcggtaccgttacggttactttagttacgggttagggtaggggagggttaggttaacggg

SEQ ID NO: 144456 - DNA, 680 bp, Homo sapiens
  misc_feature: GYAE6OF01BH92E.33.57.F02.1.454.CMB.1.raw
  modified_base (282)..(282): a, c, t, g, unknown or other
  misc_feature (282)..(282): n is a, c, g, or t
  modified_base (319)..(319): a, c, t, g, unknown or other
  misc_feature (319)..(319): n is a, c, g, or t
  modified_base (511)..(511): a, c, t, g, unknown or other
  misc_feature (511)..(511): n is a, c, g, or t
  modified_base (638)..(638): a, c, t, g, unknown or other
  misc_feature (638)..(638): n is a, c, g, or t
  modified_base (646)..(646): a, c, t, g, unknown or other
  misc_feature (646)..(646): n is a, c, g, or t
  modified_base (658)..(658): a, c, t, g, unknown or other
  misc_feature (658)..(658): n is a, c, g, or t
tcagtacacacactcacgaccggtgctcgatttagctcgatatagtgagctctgggagaagagccccagccccagaattcccaggtagtttccattcggtgatcagcactgaacacagaggactcacatggagttgggctgagtcgttgggttttccttgttaacgaattaagtaaaaggtgtaccgagtgtacgaggtgactaacgtgggtaggagtcggtggggacgaccgtggtacaagccgtggacgggtcctgagcctctcctgtcgcacggtccgntaggacttcgagcttcgaggtagaccttacgtaacgnggttcgggtcgtacgggtacctacccggaacggaccggtccgtaaccgggaagggggggtaaccgggtcgtagggtaggtcggttaactttacgatttacgtaagtttacgttaacgtccgtttactcggacccttacggaagtacgttaacccgtaatttaacggtaaatacggtgtaacaaggtttaacncggttaggacgggacgtaaccgtcgtacttaccgcccgtacgtacgaagtacgaaccgtacgccgagtactctacgtacttgtccagctaacgtcatcgtgaagcgaccgtcggtacgacgtcggtntacggttntagtggtagggngggttacgaggttcggtacggg

SEQ ID NO: 144457 - DNA, 759 bp, Homo sapiens
  misc_feature: GYAE6OF01CRJTO.33.57.F02.1.454.CMB.1.raw
  modified_base (125)..(125): a, c, t, g, unknown or other
  misc_feature (125)..(125): n is a, c, g, or t
  modified_base (146)..(146): a, c, t, g, unknown or other
  misc_feature (146)..(146): n is a, c, g, or t
  modified_base (678)..(678): a, c, t, g, unknown or other
  misc_feature (678)..(678): n is a, c, g, or t
  modified_base (748)..(748): a, c, t, g, unknown or other
  misc_feature (748)..(748): n is a, c, g, or t
tcagtacacacactcacgaccggtgctcgatttagctcgatatagtgagctctgggagaagacgccccacgccccagaacttcccgaggtagtttccagttcggtgatcagctactgaacacagngactcacatggagttggctgngtcgttgggtttttccttgttaacgtaaattaagttaaaagggtcgtacccgtagttcgtcgtaggtcgacaacgtgggtggacgtcggtgggggacaccgtgggacaacggccgtggacggtcccgtaggacgtacctcgtcgtcgaggccgacggtccgtgtcggtaacgttccgaacggtccttacgtaacggtacgtaacctaactacgtaacggtcgggtaccgtaggaccgttaccgaccggtacggccctacggggaacgggggtacggtcggttagggtacgtggttaacgtttcaatttcgtaacgtttacgtaattcccggtttctacgtcccgtaccgtacgacgttaacccctagtttaaacgtaaagttacggtacgacgtaacgtaacgttgtaggtaggtaacggtaccggtcttaacgttccgaacccggttcctaccggaaacgtaccggaaacccgtaccgggtaccgaacggtacctaccgtacttaacggttcttacgacgtagacggttanacggactacgcgtaggccgacggtacgaccgtagcgtctagtttagtacgttgtacggtagggtttacgngtaggttacgg

SEQ ID NO: 144458 - DNA, 865 bp, Homo sapiens
  misc_feature: GYAE6OF01C19AQ.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttaacaattaataaaaggtgtccagtgtcgaggtgcaacgtgggtggagtcggtgggggacaccgttggtacaaggtccgtgggacgggttccctaggacgacttcctcgtgtcgcacggccgtgtggacttcgagttccttagaacgtcgaactactaagacggtcggacgttaggacctaccgaacgacgggtaccgtaccgggaagggggtaacgggcttagggtaacggttacggtaacttttactaaacgtttaccgttaaagtttaacggttaacgttccgtttacgtttcggacccttacccggtaaaggtaccgtttaaccccgtaaacgtttaaaggtaacttaaacgttcgaaaccgttaaggtaaactttcgtaggttacggaagggtaccggtaacccggttacttacccgtaacccgttcccgtaaccggaaaggtaaccgaaacccgaaaaccgggtcccgtaaaacgggtacccgtacccgtttaaccgttaaacctttttaccggtttaaccgtacgggtacttaacgggtaacccttaagggaacccgtacgttaaccccggttaaaggaaaccggtaccggtaacccgaaacggggtacccgtacggttaaccgtttacggttaaccctttaaagggttttccggtagggggttacggggtaacgggttaaggttaggtttaacgggg

SEQ ID NO: 144459 - DNA, 843 bp, Homo sapiens
  misc_feature: GYAE6OF01BS7DB.33.57.F02.1.454.CMB.1.raw
  modified_base (100)..(100): a, c, t, g, unknown or other
  misc_feature (100)..(100): n is a, c, g, or t
tcagtacacacactcacgaccggtgctcgatttagctcgatatagtgagctctgggagaagagccccagccccagaattcccaggagtttccattcggtnatcagcactgaacacagaggactcaccatggagtttgggactgagtcttgggttttccttgtaacaattaagtaaaggtgtccagttgtcaggtgactaacgtgggtggagtcggtgggggacaccgttggtaccaggccgtgggacgggtccctaggacgtaccgtcgttccgtaggtcgaccacggcccggtacgtagggtactttccggaacgtccgttacgacggttacggaaccttaaccggtaccgaggttcggggtaccgtaggaccgttaccggaaacgtcggccgttaccgggaagggggacgggtcgtagggaaggttcggttactttacgtattttacaagggtttaacgttaacgttccgggttacgttccgacccgtttaccgaacggttaccgttaccccgtaacgttttaaagaaacgttacgacgtaacgtaagtaacttaggtaggttacgggaaggtacggtacccgtttaacgtacccgtaccgttaccgtacggtaaggaacccgtaccggaaaccggaccggtaacggaccgtaccgtttaacctatttacccggtttacgagttaaccgacgtaactaccgggtaaactaccggtacgggttaacgacgggtaaccggtacggaaaccgggttccgaaaccggttcggtttaccggtagttttaaccggttgggtttaacgggggagggtttaggggttaacggttaggggtttacggggg

SEQ ID NO: 144460 - DNA, 502 bp, Homo sapiens
  misc_feature: GYAE6OF02IZR13.33.57.F02.1.454.CMB.1.raw
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaaggtgtccagtgtcaggtgcaactggtggagtctgggggagacctggtcaagcctggagggtccctgagactctcctgtgcagccgctggattcagcttcagtgactactacatgggctggatccgacaggctccgaggggaaggggctgggagtggatttcattcattagtaatcgtcttgctccagngtccacttagaatatgcagatctgtgagnggccattcaccgtctccagacgacacgccgagcgctcactattcngcagactgaacngcctgagagccgaggaccacggctgtacttattacgttggtgggagtggaattgggg

SEQ ID NO: 144461 - DNA, 518 bp, Homo sapiens
  misc_feature: GYAE6OF02GWBHH.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctggaggtccctgagactctcctgtgcagccgctggattcagcttcagtgactactacatgggctggatccgacaggctccgaggggaagggctgggagtggatttcattcattagtatcgtctgctccagacgtccattagaatatgactagaatctgtagagacggccgattcaccgtctccagacgacaacgccgagacgctacacttattctgcagatagaacagcctagagacgccggaaggaccgacggctcggtactagttagttggtgggaggttaggagttggg

SEQ ID NO: 144462 - DNA, 532 bp, Homo sapiens
  misc_feature: GYAE6OF02GZ4AS.33.57.F02.1.454.CMB.1.raw
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtcgtgggggagacctggtcaagcctggagggtccctgagactctcctgtgcagccgctggattcagcttcagtgactactacatgggctggatccgacaggctccgaggggaagggctgggagtggattcattcattagtaatcgtcttgctccagctccacttagaatntgcagatctgtgagnggcccgtattccgaccgtcnccagacgaccacgccgagngcctcacttactttcngacagtactagaaacncgctaggagacggaccggaaggaccacgggtctgttacttaacgtttgttgggagggtaggttagggagttgggg

SEQ ID NO: 144463 - DNA, 547 bp, Homo sapiens
  misc_feature: GYAE6OF02JERB4.33.57.F02.1.454.CMB.1.raw
  modified_base (366)..(366): a, c, t, g, unknown or other
  misc_feature (366)..(366): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctggggggagacctgggtcaagcctgggagggtcccctgagactctcctgtgcagccgctggattcagtcttcagtgactactacatgggctgggatccgacaggctccgaggggaggggctgggagtggatttcattcattagtaatcgtcttgctcccagngtccattagaatatgcagaatctgtgagagggcctattccaccgtcaccgagacgacaacggccgagcncctcacttattccngccagatcgaacgtgacctggacgacggccggaagggaccacgggtccttaggttaccttagtttacggttgggagggtagggttagggaagttgggg

SEQ ID NO: 144464 - DNA, 676 bp, Homo sapiens
  misc_feature: GYAE6OF02HQWPU.33.57.F02.1.454.CMB.1.raw
tcagtacacacactcacgaccggtgctcgatttagctcgatataggtgaggctctgggagaagagtccccacgccccaggaaattcccaggagtttcccattcggtgatcagcactgaacacagaggactcaccatggagtttgggctgagtcttgggttttccttgttacaattataaaaggtgtccagtgtcaggtgcaacgtgggtggagtcgtgggggacacctggtcaagccgtggagggttccctgagactctcctgtgcacgccgctaggaattcagcttcacgtgacttactacagttcgggctggactcccgacgacggcctaccggaggggaacgggctgggaagtcggtattttcgaagtttcaagtttaggtaactcgttcttcgccgttaccccgaagtacgttaccctaacgtttaaggaaacttcgtagaccgaagtaaacttccgttaggtaggaacggaccgggtccgtaatttacccgtaccgttcctacgtaaggacgtaccgaaccggccgaagacgtccgttacaacgtttatttccgagtccaagtactaacggaaacgcgtccgtaggacgacggacccggtaaggaacccgacgggtcttaggtacctttaacgttcggttaggtcggggtaaggtttcggaagtttcgggg

SEQ ID NO: 144465 - DNA, 618 bp, Homo sapiens
  misc_feature: GYAE6OF02F0W27.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctgggagggtccctgagactctcctgtgcagccgctggattcagtcttcagtgactactacagtgggctggactccgacaggcctccgaggggaaggggctgggagtggatttcattcattagtaatcgtcttgctcccagacgtccattagaatatgacagtaatcgtgtgaggacggccgtatttccgaccgtcctccgaagacgaaccaacggccgaagacgtcctacaacttactttcgaggcctaagtaactacggaaacacgtccgttaggaaggaccggaccccgggaaggggaaccctaaccgggggtcctttacggttaaccgtttaagtttacggtttaggggttacggggggtaaggggtttagggtaagggtttacgggggg

SEQ ID NO: 144466 - DNA, 710 bp, Homo sapiens
  misc_feature: GYAE6OF02I5P01.33.57.F02.1.454.CMB.1.raw
  modified_base (211)..(211): a, c, t, g, unknown or other
  misc_feature (211)..(211): n is a, c, g, or t
  modified_base (265)..(265): a, c, t, g, unknown or other
  misc_feature (265)..(265): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaggtgtccagtgtcaggtgcaactggtggagtcgtggggganaccgtggtcaaggcctgggacgggtccctggagactcctcctgtcgcagcccgntggattcagtcttcagtgactactacagtgggctggactcccgagacggccgtaccgagggggaagggctagggagtggtatttcgatttcaagtttacgtaattccgttcttcgccttcccgaaggtacgttccctaagttttagaaattagtacgacaagtaattccgtaggtacggaggaccgggtaccgttaacgttacccgtaacccgttaccctacccgaacggtaacgaaccgaacccggaccggaagacggtacctaccgtaacgtttacttttcgtacgtacctaaggtaacgtaacggaaaccgtaccggtaccgtagggaacggtaaccggacccgggaaacgggacccgtaaccggggtccgttacggtttaccgtttaaggtttacggtttggggttaacgggggtaagggtttaggggtaaggtttggggg

SEQ ID NO: 144467 - DNA, 522 bp, Homo sapiens
  misc_feature: GYAE6OF02FRVST.33.57.F02.1.454.CMB.1.raw
  modified_base (439)..(439): a, c, t, g, unknown or other
  misc_feature (439)..(439): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctggagggtccctgagactctcctgtgcagccgctggattcagcttcagtgactactacatgggctggatccgacaggctccgaggggaaggggctgggagtggatttcattcattagtaatcgtcttgctcccagactccacttagaatatgcagaatctgtgagaggccattcaccgtctccagacgacaacgccgagacgctcactatttcngacagtatgaacagcctagagacgccggaaggaccgacggtctgtaccttagttagttggtagggtaggtaggtaagttgggg

SEQ ID NO: 144468 - DNA, 638 bp, Homo sapiens
  misc_feature: GYAE6OF02FRJ9L.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtcgtgggggagacctggtcaagcctgggacgggtccctggagactctcctgtgcagccgctggattcagtcttcagtgactactacagtgggctggactccgacgaggcctccggagggggaagggctgggagtggtatttcgattcattagtaatcgttcttgctcccgagacgtcctaacttaagaactagtcgactaagtaactcgtaggtaggaggacgggccgtaatttcccgaccgtctaccgaaggacgaaccaaccggccgtaagacgtcctacaacttacttttactcgactaagtagtaacgaaacacggtccgtaagggacggacggacccgggtaaacgggacccgtaacgggtccgtttacgtacgtttaacgtttacgggtttggggtacggggggtaacggtttagggtaaggtttcggggg

SEQ ID NO: 144469 - DNA, 564 bp, Homo sapiens
  misc_feature: GYAE6OF02GYGS1.33.57.F02.1.454.CMB.1.raw
  modified_base (447)..(447): a, c, t, g, unknown or other
  misc_feature (447)..(447): n is a, c, g, or t
  modified_base (462)..(462): a, c, t, g, unknown or other
  misc_feature (462)..(462): n is a, c, g, or t
tcagtacacacactcacgaccggtgctcgatttagctcgatatagtgagcgtctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctggagggtccctgagactctcctgtgcagccgctggattcagcttcagtgactactacagtggctggactccgacaggctccgaggggagggctgggagtggtatttcgattcgatttagtaatcgtcttgctccagacgtccacttagaatatgtacagtaactcgtagtagaggtacggccgtattccaccggtcaccgagacgaccaacgcgagacnctacaattatttccngactagtattagaactagtcccgtaggacgacgacccgggaaggaaccgacggtcttggtacttaagttggttacgggtaggggaggttacggaagttaggg

SEQ ID NO: 144470 - DNA, 537 bp, Homo sapiens
  misc_feature: GYAE6OF02G5IOL.33.57.F02.1.454.CMB.1.raw
  modified_base (303)..(303): a, c, t, g, unknown or other
  misc_feature (303)..(303): n is a, c, g, or t
  modified_base (386)..(386): a, c, t, g, unknown or other
  misc_feature (386)..(386): n is a, c, g, or t
tcagtacacacactcacgaccggtgctcgatttagctcgatatagtgagctctgggagaagagccccagccccagaacttcccaggagtttccattcggtgatcagcactgaacacagaggactcaccatggagtttgggctgagctgggttttccttgttacaattataaaaggtgtccagtgtcaggtgcaactggtggagtcgtgggggagacctgggtcaagcctggagggtccctgagactctcctgtgcagccgctggattcagcttcagtgactactacatggggctggatccganggctcgagggagggctggagtgatttcattcattagtaatcgtcttgctccagacgtaccattagaatatgacagaatcgtgngaaggtcggccgtaattccaccgtctaccaaggacaccaaggccaagtacgctacacttatttcgagactaagacttagaacagcctagacgacggaccgagggaccacgggcttagtacttagttacgtggaggggagttggaagttggg

SEQ ID NO: 144471 - DNA, 539 bp, Homo sapiens
  misc_feature: GYAE6OF02GM4K2.33.57.F02.1.454.CMB.1.raw
  modified_base (349)..(349): a, c, t, g, unknown or other
  misc_feature (349)..(349): n is a, c, g, or t
  modified_base (445)..(445): a, c, t, g, unknown or other
  misc_feature (445)..(445): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctggagggtccctgagactctcctgtgcagccgctggattcagcttcagtgactactacatgggctggatccgacaggctccgaggggaaggggctgggagtggattcattcattagtaatcgtnttgctccagatccattagatatgcagaatctgtagagaggccgattcgacccgtctccaggacgaccaacggccgagacgctacacttactttcgngcagtatacgaacagcctagacgacgccggaaggacctacgggcttacgtcttaagtttacgttggtagggggacggttgggaagtttcggggg

SEQ ID NO: 144472 - DNA, 701 bp, Homo sapiens
  misc_feature: GYAE6OF02I0O1I.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaaggtgtccagtgtcaggtgcaactgggtggagtcgtgggggagacctggtcaagccgtggacgggtccctgagactctcctgtgcagccgctggattcagcttcagtgactactacatgggctggactccgacgaggtctaccggaggggaagggtctgggagtgggtatttcattctattagttactcgttcttgcctacccgaggtacgtacctaacgttaacgaattacgtcgactaaggtaacttcgtaggtaggaacggacgggtaccgtacgtttacccgaaccggttcctacccgaaggaacgtaacccgaaaccgggcccgtaacggacggtcccttaacgttaacctttacgtttttaccgacggtaccgtaaggttacttacggaaaaccgcggtacccgttagggaccggtaacggacccgggaaaccggggtaccgaacccggggttcttacggttacgtttaacgttttaggttacgggggtacgggggttaagggttacgggtaaggtttcgggggg

SEQ ID NO: 144473 - DNA, 585 bp, Homo sapiens
  misc_feature: GYAE6OF02JB6B0.33.57.F02.1.454.CMB.1.raw
  modified_base (211)..(211): a, c, t, g, unknown or other
  misc_feature (211)..(211): n is a, c, g, or t
  modified_base (342)..(342): a, c, t, g, unknown or other
  misc_feature (342)..(342): n is a, c, g, or t
  modified_base (505)..(505): a, c, t, g, unknown or other
  misc_feature (505)..(505): n is a, c, g, or t
  modified_base (528)..(528): a, c, t, g, unknown or other
  misc_feature (528)..(528): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtctggggganacctggtcaagcctggagggtccctgagactctcctgtgcagccgctggattcagccttcagttactatggcatgccacgtgggtccgcaggcctcgacggcgaaggggctggagtggctagtcgagttanacgtcacagttagataagaaaattaaatactatgacgtaacgtccgtaggaacgggccgtattcgagtcatcgtaccagacgacaagttccaagacgtacgttgatcgagacctaaagtcggaaacggttgtacggacgtaacgagaaccgactaaccgggtnttacggtacggtttaactttcgnggttaggaaccgttaaagtaccgtttaattaccggaagttcggttattcgttaacgg

SEQ ID NO: 144474 - DNA, 597 bp, Homo sapiens
  misc_feature: GYAE6OF02J0EQ9.33.57.F02.1.454.CMB.1.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (470)..(470): a, c, t, g, unknown or other
  misc_feature (470)..(470): n is a, c, g, or t
  modified_base (493)..(493): a, c, t, g, unknown or other
  misc_feature (493)..(493): n is a, c, g, or t
tcagtacacacactcacgaccggtgctcgatttagctcgatatagtgagctctgggagaagagccccagccccagaattcccaggagtttccattcggtgatcaacactgaacacagaggactcaccatggagtttggctgagctgggttttcctgttacaattataaaaggtgtccagtgtcaggtgcaactggtggagtctggggganacctggtcaagcctggagggtccctgagacctctcctgtgcagccgctggattcgagtcttcagtgactactacatgggctggatccganaggctccgagggaagggctgggagtggatttcgagtttcagttaagtaacttcggtacttggaccttcccgagtacgtcccaagtttagaacttagtgacaagtatctggtgaagaggccgtattccgaccgtctccagacgacaacgtcgagacgcgtacacttattcncgtacaggtaacttcggaaaacncggtaaccctgggtaagacggtccggaacggaccgtaacgggtcttacggtactttacgttaacgtttacgggacggggtatacggggtaattgggttaacggg

SEQ ID NO: 144475 - DNA, 517 bp, Homo sapiens
  misc_feature: GYAE6OF02F8R14.33.57.F02.1.454.CMB.1.raw
  modified_base (351)..(351): a, c, t, g, unknown or other
  misc_feature (351)..(351): n is a, c, g, or t
  modified_base (409)..(409): a, c, t, g, unknown or other
  misc_feature (409)..(409): n is a, c, g, or t
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctgggtcaagcctggagggtccctgagactctcctgtgcagccgctggattcagcttcagtgactactacagtgggctggactccgacaggcctccgaggggagggctgggagtggattcattcattagtatcgtntgctccagactccattagatatgacagatcgtgtagacgaggcctattccgaccgtcnccgagacgacacgccgagacnctcattacttcgngacagatcgaacagcctaggacgagccggaaggaccaggctgtctagtttgtggtagggaggtaggagttgggg

SEQ ID NO: 144476 - DNA, 640 bp, Homo sapiens
  misc_feature: GYAE6OF02GJVR0.33.57.F02.1.454.CMB.1.raw
  modified_base (300)..(300): a, c, t, g, unknown or other
  misc_feature (300)..(300): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctgggagggtccctgagactctcctgtgcagccgctggattcagcttcagtgactactacatggctggatccgacnggctccgaggggagggctggagtggtatttcattcattagtaatcgtcttgcctcccagacgtccaactttagaatagtgacgtagaacttcgtaggtagaaggacggacccgtattcccgaccgttcctaccgaaggacgaaccaacggccgaagacgtcctacgtaactttacgttttccgtaggacctaagtaacttacggaaaaccctaaggtccccgtagggaacgtaccggacccgggtaaacggggaacctaaccggggtcttacggttacctttaaagtttaagggttccgggggttagggggtaacgggtttagggtaagtttacgggggg

SEQ ID NO: 144477 - DNA, 665 bp, Homo sapiens
  misc_feature: GYAE6OF02JNN3S.33.57.F02.1.454.CMB.1.raw
  modified_base (244)..(244): a, c, t, g, unknown or other
  misc_feature (244)..(244): n is a, c, g, or t
  modified_base (650)..(652): a, c, t, g, unknown or other
  misc_feature (650)..(652): n is a, c, g, or t
tcagtacacacactcacgaccggtgctcgatttagctcgatatagtgagctctgggagaagagccccagtcccagaattcccaggagtttccattcggtgatcagcactgaacacagaggactcaccatggagttggcgtgagtcgttcggttttccgttgttactaattaataaaggtagtcctagtgtcgtaggtgacaacgtggtggtagtcgtggggacggacgtggtacgacgcgtggnacggtcccgtgacgactctccgtgtcgctacggtacccggtaccgttacggtacgtttaccgtacggtaccgttaccgtaacggttacggtaaccgttaaccgttaaccgtaacggttacgggtaccgtacgggtaacgttacccggtaaccgtaacgggtaccgtaccggaacgggggaacggggtaccggtacgggtaacgggttacggttaacgtttacgttaacgtttacgttaagtttaacgttaacgttaccgttacgttacgtaccgtacccgtacgtacgtaccgtaacgttaacgtaaacgtacgtacgtacgtaacgtaacgtacgtacggtacggtaggtaacggtaccgtaacgttaccgtaccgtaccgtacgacgacgaacgaacgacgacnnncgtacctactacg

SEQ ID NO: 144478 - DNA, 678 bp, Homo sapiens
  misc_feature: GYAE6OF02JPVNQ.33.57.F02.1.454.CMB.1.raw
  modified_base (213)..(213): a, c, t, g, unknown or other
  misc_feature (213)..(213): n is a, c, g, or t
  modified_base (289)..(289): a, c, t, g, unknown or other
  misc_feature (289)..(289): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggganacctgggtcaagcctggagggtccctgagactctcctgtgcagccgcgtggattcagtcttcagtcgactactacngtgggctggatccgacgagcctccgaggggaagggctgggacgtggtatttcgagttacagtttaagtatcgttcgttcggacctccaaggtacgttcccaaacgttttaagaaagttctacgactaggtaatctggtagtaggacggccgttattacgtaccgtcgttaccgacggaaggtaacccaaccggaccgaggtaacgaccgttacgtacgttaacttttccgacgtaaccaacggtaacgtaccgtaaaccggtacgtccggtaagtacgggaaccgacccgggtaagggaacccgaccggggttcgttacggtttaacctttacgtttacgggttcgggtttaacgggggaggtttaaccggggtaaggtttacgggggg

SEQ ID NO: 144479 - DNA, 574 bp, Homo sapiens
  misc_feature: GYAE6OF02GBQ4R.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtcgtgggggagacctggtcaagcctggagggtccctgagactctcctgtgcagccgctggattcagcttcagtgactactacagtgggctggactccgacaggcctccgaggggaagggctgggagtggctgtcatagtgcttcgtgggaggtgagtgggtcgcgttcttcgacggcggtacttcgtggtggacggggccgtagttcgacgcctacgttccgaaggtacgaaccaaccgacccaaacgtacctccctagcctactcctccagtacgtacggaacctaaccgtgaccgaggaccgacggaccgacggctaagtacttaattaccgtggtacgaccgacgacggtaccttagacggacaggtcgg

SEQ ID NO: 144480 - DNA, 529 bp, Homo sapiens
  misc_feature: GYAE6OF02IFWVT.33.57.F02.1.454.CMB.1.raw
tcagtacacacactcacgaccggtgctcgatttagctcgatatagtgagctctgggagaagagccccagccccagaattcccaggagtttcccattcggtgatcagcactgaacacagaggactcaccatggagtttgggctgagctgggttttccttgttacaattataaaaggtgtccagtgtcaggtgcaactggtggagtcgtgggggagacctggtcaagcctggacgggtccctgagactctcctgtgcagccgctggattcagtcttcagtgacttactacagtgggctgggactcccggacaggcctccgaggggagggctgggagtgtatttcgatttcattagtaatcgttctgctcccgagacgtccattagattatgcagaatgtgtgagaggcctatcgacgtctacagacgacacgcgagcgactcacttattctgcagtaactgaaaccagtccagacgacgccggaaggacacggcttagtcttagttagttggtagggtaggtggagttggg

SEQ ID NO: 144481 - DNA, 659 bp, Homo sapiens
  misc_feature: GYAE6OF02JIUI4.33.57.F02.1.454.CMB.1.raw
  modified_base (304)..(304): a, c, t, g, unknown or other
  misc_feature (304)..(304): n is a, c, g, or t
tcagtacacacactcacgaccggtgctcgatttagctcgatatagtgagctctgggagaagagccccagccccagaattcccaggagtttccattcggtgatcagcactgaacacagaggactcacatggagttgggctgagctgggttttccttgttacaattataaaggtgtccagtgtcaggtgcaactggtggagtcgtgggggagacctggtcaaggccgtgggacgggtccctgagacctctcctgtgcagccgcgtggattcagtcttcagtgactactacagtggctggatccganagcctccggagggacgggctgggagtggtattcgattcagttaacgtatcgttcttcgcctacccagtacgtacctaacttaagaattacgtcgtaacgaagtaactcgtagagggtaacggtacgggtacccgtaagtttcccgaacccggtttccgtaacccgtaaagggaaaccggtaaccccaaaccgggcccggaaagtaccggtcctaacccgtaacgttttacgttccgtacgctaaaggtacttacggaaactacgtcgtaggacgaccgaccggtacgggaacctacgggtccttagtaacgttagtttaggtcgggttaaggggacggttagggtaacgttgggg

SEQ ID NO: 144482 - DNA, 505 bp, Homo sapiens
  misc_feature: GYAE6OF02G8A6R.33.57.F02.1.454.CMB.1.raw
  modified_base (371)..(371): a, c, t, g, unknown or other
  misc_feature (371)..(371): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
  modified_base (494)..(494): a, c, t, g, unknown or other
  misc_feature (494)..(494): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctggagggtccctgagactctcctgtgcagccgctggattcagcttcagtgactactacatgggctggatccgacaggcctcgagggagggctgggagtggatttcattcattagtaatcgtcttgctcccagactccattagaatntgcagatctgtagagacggcctatccgaccgtctaccagacgacgaacgccgagcgctacacttatttcngacagatcgaacngcctagagcgcggaggacgcggctgtctagttctggtggnggtggagtggg

SEQ ID NO: 144483 - DNA, 549 bp, Homo sapiens
  misc_feature: GYAE6OF02GWJ8R.33.57.F02.1.454.CMB.1.raw
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagaccgtggtcaagcctgggacgggtccctgagactctcctgtgcacgccgctggattcgagtcttcagtgactactacagtgggctggactccgacaggctaccgaggggacgggctgggagtggattcgattcattagtatcgtntgctccagcgtccattagatgngacagatcgtgtgagcgcctattccgacgtctacagacgacaacgcgagacgctacattacttcgagactagatacgaactacgctaggacgacgcccggaaggtaccgacggtcttcgttacgttaatttcgggtagggtaggggtaaggttacggtaaggttcgggg

SEQ ID NO: 144484 - DNA, 578 bp, Homo sapiens
  misc_feature: GYAE6OF02GW63C.33.57.F02.1.454.CMB.1.raw
  modified_base (212)..(212): a, c, t, g, unknown or other
  misc_feature (212)..(212): n is a, c, g, or t
  modified_base (405)..(405): a, c, t, g, unknown or other
  misc_feature (405)..(405): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctggggganacctggtcaagcctggagggtccctgagactctcctgtgcagccgctggattcagcttcagtgactactacagtgggctggactcccgacaggctccgaggggagggctggagtggatttcattcattagaatcgtcttgcctccgagtacgtccacgttagaatacgtgacaagtaattcgtaggtagaagnggcccgtatttaccgaccggttccaccgaaggacgaaccgaaccgccggaagacgccgttactaacttactttcgngacctagacgtcgaaacngtcctaggacgacgccggaaggaccacgggtcttacgtcttaagtttggttaggtggggtaggtacggtaagttcgggg

SEQ ID NO: 144485 - DNA, 613 bp, Homo sapiens
  misc_feature: GYAE6OF02GYZ2O.33.57.F02.1.454.CMB.1.raw
  modified_base (189)..(189): a, c, t, g, unknown or other
  misc_feature (189)..(189): n is a, c, g, or t
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
tcagtacacacactcacgaccggtgctcgatttagctcgatatagtgaggctctgggagaagagccccagccccagaattcccaggagtttccattcggtgatcagcactgaacacagaggactcaccatggagtttgggctgagctgggttttccttgtacaattataaaggtgtccagtgtcaggtncaacgtggtggagtcgtgggggagacctggtcaagcctgggacgggtcctgagactctcctgtgcagccgntggattcagcttcagtgactactacagtgggctggactccgganacggctccgaggggaacggggctgggaggtggtactttcgattcagtttagtaattcgtcgttcgcctcccgaggtacgtcctaacttagaattatggactaggtaactcgtgtagaacgtacgggccctaagtttccgacccggttcctaccgaagtacgaaccgaaccggccgaaggacgccttacaaacctttagtttccgtacggacctaaggtattacgaaaccgtagcctaggacgacggaccggaaggtaccacgggtctgttactagtttaggtggtaggggtacggttaggagttcgggg

SEQ ID NO: 144486 - DNA, 549 bp, Homo sapiens
  misc_feature: GYAE6OF02HL5VX.33.57.F02.1.454.CMB.1.raw
  modified_base (356)..(356): a, c, t, g, unknown or other
  misc_feature (356)..(356): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (508)..(508): a, c, t, g, unknown or other
  misc_feature (508)..(508): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcttgttacaattataaaaggtgtccagtgtcaggtgcaactggtggagtcgtgggggagacctggtcaagcctgggagggtccctgagactctcctgtgcagccgctggattcagtcttcagtgactactacagtgggctggactccgacgaggctccgaggggaaggggcgtgggagtggtatttcattcattagtatcgtntgctccagacgtccattagaatgtacgcaagattcgtggtagaggcggacctattccgaccgttcacaggaacgaccaacggccgaagcgactcaacttctttcngcaaggctaggaacncgccgtagacgacgaccggaaggaccgcggtnttcgtattagttagttgggtaggggaggttggagttagggg

SEQ ID NO: 144487 - DNA, 528 bp, Homo sapiens
  misc_feature: GYAE6OF02FL00C.33.57.F02.1.454.CMB.1.raw
  modified_base (347)..(347): a, c, t, g, unknown or other
  misc_feature (347)..(347): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctggagggtccctgagactctcctgtgcagccgctggattcagcttcagtgactactacatgggctggatccgacaggctccgagggagggctgggagtggatttcattcattagtaatcgtnttgctcccagtacgtcctacgttacgaatagtgcagtaatcgtgtgagacggccgtattccgacgtctccagtacgaccacgccgagacgctcactattcngcagactgaacngcctgagacgcccggaaggacacgggtctacggttctaatttggtaggtgggtaggtaggtagttggg

SEQ ID NO: 144488 - DNA, 747 bp, Homo sapiens
  misc_feature: GYAE6OF02F52XJ.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtccagtgtcaggtgcaacgtggtggagtcgtgggggagacctggtcaagcctgggacgggtcctggacgactctcctgtgcacgccgctggatttcagtcttcagtcgacttactacagtcgggctggactcccggagacggcctccggaagggggaacgggtcgtaggggagttgggtacttttacgagtttactaagttaaggttaacgttccgttcgtttcgcccttccccgaaggtaccgttaccctaaagtttaagaaattcgtaggaactaacggttaaacttccgtaggttacgggaaacggcgggacccgttaagtttccccggaaacccgttccgtacccgaaggaaacgaacccgaacggtcccggaagacccggtaccttacgtaccttttaacgtttttccaacggtactaacggtacgttaaacgacccgtaggtacccgttaggacggaaccggtacccggggaaagggacccgtaaccggggtcttacggtttaaccgttaagttttcgggttccggggttaagggggagtttacggggtaattttacggggggg

SEQ ID NO: 144489 - DNA, 593 bp, Homo sapiens
  misc_feature: GYAE6OF02IT0ZY.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctggagggtccctgagactctcctgtgcagccgctggattcagcttcagtcgactactacagtgggctggactccggacaggctccgaggggacgggctgggagtggatttcattcattagtaatcgtcttgcctccagacgtccagttaagaatagtgacagtaactcgtgagaggacggtccgtattcccaccggttcaccgaaggacgaacgaacccgcggaagacgcctacgtaacctttatttccgtgacgtaacgtagttacgaaacctggtcccgtaagacgggacgcccgggaaaggaccgacggtctacgttaccttagttaaggtttcgggaggggtaaggttgggaagtttcggggg

SEQ ID NO: 144490 - DNA, 588 bp, Homo sapiens
  misc_feature: GYAE6OF02F84TO.33.57.F02.1.454.CMB.1.raw
  modified_base (490)..(490): a, c, t, g, unknown or other
  misc_feature (490)..(490): n is a, c, g, or t
  modified_base (505)..(505): a, c, t, g, unknown or other
  misc_feature (505)..(505): n is a, c, g, or t
  modified_base (567)..(567): a, c, t, g, unknown or other
  misc_feature (567)..(567): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattaataaaaggtgtccagtgtcaggtgcaactggtggagtcgtgggggagaccgtggtcaagcctgggacgggtccctgagactctcctgtcgcagccgctggacttcagtcttcagtgactactacagtgggctggactccggacgaggcctaccggaggggaaggggctagggagtggtatttcgattcgattagtatcgttcttcgcctaccgagtacgtccacttaagaattagtcgacgagtaacttcgtagtaggagtacggccgtattccgaccgtctaccgagacgacgaacgccgagacgtctacgacttatttcngacagtactagaacngtaccgaggacgacggcggaacggaccgacgggtcttagttaccttagtttacggttagggngggtaggtaggtaggttgggg

SEQ ID NO: 144491 - DNA, 682 bp, Homo sapiens
  misc_feature: GYAE6OF02F6OLQ.33.57.F02.1.454.CMB.1.raw
  modified_base (222)..(222): a, c, t, g, unknown or other
  misc_feature (222)..(222): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctggggganacctggtcaagcctggacggtcctgagactctctggtgccaggccgatggattcagcttcagtcgactacacatggggactgggactccgacaggctccggagggaggggctaggagttcggatttcgattcaatttacgaattcgtcttgcttcccgaagtcgttccaacgtttagaaacttagtcgactaagtaacttcgtaggtgaacggtacggtccgtaacttccgaacccgtttcctaccgaacggtacgaaccgaacccggtccgaacggacggtacctaccctaaccgtttacttttccggagttaccgagtaacgtacggaaactaccgggaccttagggacggaaccggaccccgggtaagggacccgtaacggttcccgttacggttttaactttaacggtttttaaccggttgggggttaacggggggacggtttcggggtaaacggg

SEQ ID NO: 144492 - DNA, 579 bp, Homo sapiens
  misc_feature: GYAE6OF02HZQXG.33.57.F02.1.454.CMB.1.raw
  modified_base (385)..(385): a, c, t, g, unknown or other
  misc_feature (385)..(385): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctggagggtccctgagactctcctgtgcagccgctggattcagcttcagtgactactacagtcgggctggatccggacaggcctaccgaggggaacgggctgggagtgtatttcagttcattagtatcgtcttgcctccagtacgtcctattagaattangaccagtaacttcgtagtgaggacggcctagttccaccggtctccgaagacgaacgaaccgccgaagtacgaccttacgaactttacttttcgagaaccagacttaaggaaactaccgcgttagaggaccggaccggaaggaccacgggtctagtcttagttacggtgggtacgggaggttgggtaaggttggg

SEQ ID NO: 144493 - DNA, 865 bp, Homo sapiens
  misc_feature: GYAE6OF02FZKUO.33.57.F02.1.454.CMB.1.raw
tcagtacacacactcacgaccggtgctcgatttagctcgatatagtggtaggctctggagaagagccccagccccgagaattcccaggagtttccattcggtgatccaggcactgtaacacagaggactcaccatggagtttgggctgagctgggttttccttgttacaattataaaaggtgtccagtgtcaggtgcaacgtggtggagtcgtgggggagacctggtcaagcctggacggtccctgagactctccgtgtgcacgccgctaggattacgagtcttacgagttcgacctactacgagtggggctagggacctcccgacgacggtcctccggaacggggtaaggggtcctaggggtaggtcgggtacgttttaccgaacgtttacgtaacgtttaacgtaacgttccggttacttcgtaccgttacccgaacggtacggttacccgtaacgtttaaggaacttacgtcgtacctacggtaactttccgtaggtaggtaacgggtacgggtaccccgttaagtttaccccgaacccggttacctaacccggtaaagggtaacgtaaacccggtaaaccggtccccgggtaaaggtaacccgttcgtttaaacccgttaacggttttaaccgttttccgtaacggtacccgttaagttaacggttaaccgtaaaacccggttaccgttaaccccggttacgtaaccggggtaaccgggtacccccggggtaaacgggtaaccccgggtaaccgggtaaccggtttacggttttaaaccgttaacggtttttaacgggtttacgggggttaacgggggggttaacgggtttaacggggtaaacgggtttttaacggggggg

SEQ ID NO: 144494 - DNA, 574 bp, Homo sapiens
  misc_feature: GYAE6OF02IEQPD.33.57.F02.1.454.CMB.1.raw
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgtacaattataaaaggtgtccagtgtcaggtgcaactggtggagtcgtgggggagacctgggtcaagcctgggagggtccctgagacctctcctgtgcagccgcgtggattcagtccttcagtcgactactacagtgggctggactccgacgaggcctccggaggggagggctggacgtggtatttcattcattagtactcgtctgcctccagcgtcattagaatngcagacttcgnggtgacggacggctactttccgaccgttctccgaagaacgtaccaaacgggtcccagaccncctagtacctttagttccgngtaccaaggttntacggaacncggacctggaacggccgcgaaggacctacgggtccttgtacctttagtcggttgagggggtaatgggtagtttcgggg

SEQ ID NO: 144495 - DNA, 575 bp, Homo sapiens
  misc_feature: GYAE6OF02FZELF.33.57.F02.1.454.CMB.1.raw
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaggtgtccagtgtcaggtgcaactggtggagtcgtgggggagacctgggtcaaggcctggagggtcccctggagactctcctgtcgcagccgctggattcagcttcagtgactactacagtgggctgggactcccggacacggcctccggaggggaacggggctagggagtgggattttcagtttcaatttagtaatcgtcttgctcccagtacgtcctattagaatgtgacagaactcgtgtagagacggtccgtattccgaccgtcctaccgagacgacaacgccgaancgctacactacttcngcagtactacgaaacgcgtccagacgacggaccgtaaggaccacgggtcttacggtacttaagtttgtacgggtagggtacgggtaggtaaggttcgggg

SEQ ID NO: 144496 - DNA, 780 bp, Homo sapiens
  misc_feature: GYAE6OF02JY9PP.33.57.F02.1.454.CMB.1.raw
  modified_base (255)..(255): a, c, t, g, unknown or other
  misc_feature (255)..(255): n is a, c, g, or t
tcagtacacacactcacgaccggtgctcgatttagctcgatatagtgagctctgggagaagagccccagccccagaattcccaggagtttccattcggtgatcagcactgaacacagaggactcaccatgggacgtttgggctgagctgggttttccttgttaacaattataaaggtgtccagtgtcaggtgcaactggtgagtcgtggggagacctggtcaagcctggagggtccctgagactctccgtgtgcngtccgctggattcgagtcttcgagtcgaactacttacgagtggcctgggacttcccggacgacggtccgtccggaagggggaacgggtccgtagggaaggtcgggtacttttccgaagtttacctaaacgttagttaacgttcggttacgtttaccggtcctttaccccgaggtaacgtacccgttaacgttaacggaaacttactacggtctaaacgggtaacttccggtaggttacgaaacgggtccgggaaccgttaacgtttccccggacccggtttaccttacccgaagggttaaccgaacccgttaaaccgggacccgttaaaggccggacctttaacccgacgttttaaacccgtttggttaaccgacccgtaacgggttaacttccggaaacccgtaggtcccctaggaacggtacgggtaccccggtaagggaaccccgtcgggtaccgttaccgttacggttttaaaccgtggtttacggggacgggtaccgggttaggtaacgtttccgggggg

SEQ ID NO: 144497 - DNA, 579 bp, Homo sapiens
  misc_feature: GYAE6OF02FTFL0.33.57.F02.1.454.CMB.1.raw
  modified_base (297)..(297): a, c, t, g, unknown or other
  misc_feature (297)..(297): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtcgtggggggagacctggtcaagcctgggagggtccctgagactctcctgtgcagccgctggattcagcttcagtgactactacagtgggctgggntccggacaggcctccgaggggaaggggctgggagtggatttcattcatttagtaatcgtcttgctcccagctccattagaatatcgcaagaattcgtaggtgaggacgggccgtattccgaccgttcctaccgagaacgaccaacggcccgagacgcctactacttagtttcctgaccagtactaggaaccaggccctagacggcggacccggaggaaccgacggtccgtagttccgttaatttacgttggggttagggacgggtttaggtaagttacgggg

SEQ ID NO: 144498 - DNA, 561 bp, Homo sapiens
  misc_feature: GYAE6OF02GAJNC.33.57.F02.1.454.CMB.1.raw
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtctgggggagacctggtcaagcctggagggtccctgagactctcctgtgcagccgctggattcagcttcagtgactactacagtgggctagggactcccggacacgggcctaccggaggggaggggcctgggagtggatttcgattctatttagtaatcgtcttgcctcccgagtacgtcctaacgttanaatatgacagatctgtgacgnggaccgtattccgaccgtctccgagacgacgaacgccgagactctactacttactttcagtacgagactagacacgtcctaggacgagccggaaggaccacggctaggtcttagttcgttgggtggggtaaggtagggtagttagggg

SEQ ID NO: 144499 - DNA, 550 bp, Homo sapiens
  misc_feature: GYAE6OF02F8OOD.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtcgtgggggagacctggtcaagcctgggaggtccctgagactctcctgtgcagccgctggattcagcttcagtgactactacagtgggctggactccgacgacggcctaccgaggggaagggctgggagtggtatttcattcattagtatcgtctgctccgagacgtccattagaatgtgactaggatcgtgagaggtacggcctattccaccgttcaccagacgaccaacggccgaagcgcctactacttattcgagacctagactagaacagtcctagacgacgaccggaggaccgcggctacggttacttagtttacgtagggtaggggacggttaggaggttggg

SEQ ID NO: 144500 - DNA, 563 bp, Homo sapiens
  misc_feature: GYAE6OF02G69CJ.33.57.F02.1.454.CMB.1.raw
  modified_base (380)..(380): a, c, t, g, unknown or other
  misc_feature (380)..(380): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaaggcctggagggtccctgagactctcctgtgcagccgctggattcagcttcagtgactactacagtgggctgggatccgacaggctccgaggggaagggctggagtggtatttcattcattagtatcgtcttgcctccgagtacgtccattagaattntcgacagtatctgtgaggacggcgtagttccaccgtctaccgagaacgacaacggccgaagacgcctacacttattctgacagtactagacgtagccgtagacgacgaccggaagggacccgtacgggtacttcgttactttagtttacgttgggttaggggtacgggttgggtaagttgggg

SEQ ID NO: 144501 - DNA, 708 bp, Homo sapiens
  misc_feature: GYAE6OF02I85BC.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtggggggagacctgggtcaagcctggagggtccctggagactctcctgtgcagccgctggattcagtcttcagtcgactactacagtgggctgggatccggagacggcctaccgaggggaacggggctgggagtgggatttcagtttcagtttagtaattcgtctttcgccttcccgagtacgtccctaactttaaggaaacttagtggtaccaaggtaaacttcgtaggtaggaaggacgggtcccgtaatttcccgaacccggttctacccgaaggtaacgaaccgaaccggtcccgaaggcggtacccttacgaactttacgttttccgacgtacgtaacgtaacttacggaaaccgtaccggtccgttaggacggtaaccgggacccgggtaagggtaacccggtaccggggtaccttacgggtttaccgttaaggtttttaacggttttcgggggtaagggggtacgggggtttagggtaaacgggttttcgggggg

SEQ ID NO: 144502 - DNA, 614 bp, Homo sapiens
  misc_feature: GYAE6OF02FSBKV.33.57.F02.1.454.CMB.1.raw
  modified_base (223)..(223): a, c, t, g, unknown or other
  misc_feature (223)..(223): n is a, c, g, or t
  modified_base (506)..(506): a, c, t, g, unknown or other
  misc_feature (506)..(506): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggganacctggtcaagcctggagggtccctgagactctcctgtgcagccgctggattcgagcttcagtgactactacagtggctggactccgacgacgctccgaggggaagggctagggagtggtatttcagtttctaattagtaatcgttcgttcgtctccctaggacttccgtaacttaacgtaagtactagacgtaagtaattcgtgtaggaggtacgggcccgtattaccgaaccgtctaccgaagtacgaccaaccgaccgagacgtctacacttactttcgngaccgaagtactagaactacgtccgtgaaccgtacggccggaaggaccgtaccggtccgttacgtatttacggttacggtttgggtacggggtaggttaggtaacggg

SEQ ID NO: 144503 - DNA, 794 bp, Homo sapiens
  misc_feature: GYAE6OF02HF665.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtgggggagaccgtggtcaagccgtgggacgggtccctggagactctcctgtgcagccgcgtggacttcagtcttcagtgactactacagtgggctggactccgagacggcctccggaaggggaacggggcgtagggagtggtatttcgattactaagtttaagtaacgttcgttcttcggccttacccgaaggtacgttaccctaaacgttttaaagaaactttacgtacggtaacgtaaagttaaacgtttcggttagggttaacgggaacggggtacccggggtaacccgtttaaacgtttaccccggtaaccccgtttacccgtaacccgaaagggtaaaccgtaaaccccgaaacccggggacccggtaaagtaaccgtcccttaaccgttaaaccgttttacgttttaccgacggaacctaaggtaacgttaaacggaaacctacgggtcccgttaaggggacccgggggaaccggtaacggggaacccgtaaccggggttacttacgggttacctttaaggtttacgggttacggggttagggggtaagggtttacgggtaagggttcggggttttaagggg

SEQ ID NO: 144504 - DNA, 928 bp, Homo sapiens
  misc_feature: GYAE6OF02JJTVV.33.57.F02.1.454.CMB.1.raw
  modified_base (267)..(267): a, c, t, g, unknown or other
  misc_feature (267)..(267): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcgtgggttttccttgttacaattaataaaaggtgtcctagtgtcaggtgcaactgggtgagtcgtgggggacgacctggtcaagcctggacgggtccctgacgactcgtcctgtgcgagccgngtggattcgagtccttcaggtcgactactacgagtcgggtactacgggactcccggacgtacggtccgtacccggaaaggggggtaacgggggcttagggggacggttgggtaactttttaccaagtttcgtaacgttttaaaggtaaacgtttccgggttactttcgggccccctttaaccgggttaacgggacccgtttaaccccgttaaaacggttttaaaacgaaacgtttacggggttactaaccgggttaaaacgtttaaacccggttacgtttacgggggtaaacgggttaacggggtacccggggttaaacccccgttttaacggtaaccccccgttacccgggtttaccccctaaaccggaaaccgggttaaaacccgtaaaacccggaaaccccccggggttaaacgggtaaccgggtaaccccggtacctttaaaccgggttaaccctttttacccgttaaccgggttacgaaacccggttaacggtaagtaaacccggtaccgtaacgggtaaccgtaacgggtaacgacccgggtaaccgggaaacccggtaaggggtacccttaaccgggtagtttaaccggtttaagttcgggggttttagggaacggggtttaacggggttaccgggttaaagggtttccggggg

SEQ ID NO: 144505 - DNA, 597 bp, Homo sapiens
  misc_feature: GYAE6OF02JB240.33.57.F02.1.454.CMB.1.raw
  modified_base (221)..(221): a, c, t, g, unknown or other
  misc_feature (221)..(221): n is a, c, g, or t
  modified_base (318)..(318): a, c, t, g, unknown or other
  misc_feature (318)..(318): n is a, c, g, or t
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
  modified_base (470)..(470): a, c, t, g, unknown or other
  misc_feature (470)..(470): n is a, c, g, or t
  modified_base (515)..(515): a, c, t, g, unknown or other
  misc_feature (515)..(515): n is a, c, g, or t
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggttttcctgttacaattataaaagtgtccagtgtcaggtgcaactggtggagtcgtggggganaccgtggtacaagcctgggagggtccctgacgactctcctgtgcagccgcgtggatcagtcttcagtgactaacgtacagttggctggactccgacnggcctaccgagggaggcgtaggagtggtattnagttcaattagtaacttcgtcttcgcctaccgagtacgtctaacgttaagatangacagaagttcagtgacgacggctacgttccgaccgttctaccgaagacgaacgaccgaccggtanaccggtcctacgtacttacgtttcgcgtaacagtatacggaaacncgtcctaggaacgtaccgccgggtaacgcccgtaacggcttacgtaggttaacttggtgggacggggttagtaggtaacggg

SEQ ID NO: 144506 - DNA, 623 bp, Homo sapiens
  misc_feature: GYAE6OF02FYCSR.33.57.F02.1.454.CMB.1.raw
  modified_base (307)..(307): a, c, t, g, unknown or other
  misc_feature (307)..(307): n is a, c, g, or t
  modified_base (492)..(492): a, c, t, g, unknown or other
  misc_feature (492)..(492): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtgggggagacctggtcaaggcctgggagggtccctgagactctcctgtgcagccgctggattcagtcttcagtgactactacagtgggctggatccggacnggcctccgagggggaagggctgggagtggtatttcattcaatttagtaatcgttcttgccttcccgagtacgtacctaacgttagaattagtgcaagtattcgtggtaggaggaggtcccgtattcccgaccgttcctaccgaggaacgaccgaaccggccgaagacgtccttacgtaacctttntttcgacgcgaagtactacgaaacgtcgtacccgtagggaacgacgggacccggaagggaacccgtacgggccttagttaccgttagtttacgttgggggtaggggtaggttaggggtaagtttacggggg

SEQ ID NO: 144507 - DNA, 805 bp, Homo sapiens
  misc_feature: GYAE6OF02JL9JR.33.57.F02.1.454.CMB.1.raw
  modified_base (297)..(297): a, c, t, g, unknown or other
  misc_feature (297)..(297): n is a, c, g, or t
tcagtacacacactcacgaccggtgctcgatttagctcgatatagtgagctctgggagaagagccccacgccccagaattcccaggagtttcctattcggtgatcagcactgaacacagaggactcaccatggtagttggtcgtgagtcgttgggttttccgttagttactaattaagtaaaggtagtacgtagtgtcgtaggtgacacgtggtggtagtcgtaggggacggtacgtacggtacgtaacgtaccgtacggacggtaccgtacgacgtacgtacctcctcgtgtcgangtaccgcgtcggagttaccgtacgtacgttacgtaacggtacggtaaccgtaaccgtaaccgtaacgttacgggtaccggttacgggtaacgtacccggtaaccgtaaccgggtaccggtacccggtaacggggtaaacgggggtaccggtacgggtaacgggttacgggtaacggtttacgttaacgttacgttaacgtttaacgttaaacgttaccggttacgtttacgttaccgttacccgtaaccgtaacggttacccgtaaccgttaacgtaaacgttaacgtaacggtaacgtaacgtaaacgttacgttacggtacggtaacggtaacggtaccggtaacgttaccgtacccgtaccgtaccgtaacgaacgtaaccgtaacgacgacgacgacgtacgtactacgtacgtacgtacgtacgtatacgacgacgaccgtacgtaacgtacggaccggaacggaaccggtaaccggtacgtacggtaccgttaacgttaacg

SEQ ID NO: 144508 - DNA, 583 bp, Homo sapiens
  misc_feature: GYAE6OF02HZ7G0.33.57.F02.1.454.CMB.1.raw
  modified_base (472)..(472): a, c, t, g, unknown or other
  misc_feature (472)..(472): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagccgtggagggtccctgagactctctgtgcacgccgctggattcagcttcagtgactactacagtggctggatccgacaggcctccgaggggacgggctggaggtggtatttcgattcagttagtaatcgttctgcctcccagcgtaccattagaattatcgacagaatcgtgtggagacggaccgtattccgaccgtcctaccgagaacgaccaaccggccgaagagtcctcgtaacttatttaccgngacaagattacgaaacgcgtccaggacgacgggaccgaacgggtaccgaccgggtcttacgtacgtttaagttacggttcgggttaaggggtacggttgggtaagttgggg

SEQ ID NO: 144509 - DNA, 609 bp, Homo sapiens
  misc_feature: GYAE6OF02GJDB7.33.57.F02.1.454.CMB.1.raw
  modified_base (213)..(213): a, c, t, g, unknown or other
  misc_feature (213)..(213): n is a, c, g, or t
  modified_base (540)..(540): a, c, t, g, unknown or other
  misc_feature (540)..(540): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggganacctggtcaagcctggagggtccctgagactctcctgtgcagccgctggattcagtcttcagtgactactacagtgggctggactcccgacaggcctaccgaggggaacgggctgggagtggatttcgattcattagtaatcgtcttgcctcccgagacgtcctaagttaagaattagtcgactagtaacttcgtagtggaaggacgggtcctagttccaccggtctaccgaagacgaccgaacgccgagacgtcctacaacgttactttcgcgacgtagtacgtacgaaaccgacgtcctagacggacggacccggaagggaaccncggggtacttacggttacctttaagtttacggttagggtcggggtaagggttgggtaaacggtttgggg

SEQ ID NO: 144510 - DNA, 672 bp, Homo sapiens
  misc_feature: GYAE6OF02GL1Q5.33.57.F02.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtggggganacctgggtcaagcctggaggtccctgagactctcctgtgcagccgngtggattcagtcttcagtcgactactacagtgggtctagggactccggacgacgggcctaccggaaggggggtaacggggtcgtaggggtaggtggttacgttttactagtttacgaagtttagtaacgttcgttacgttcgtacctacccgagtacgtacctaacgtttaagaatagtcgactagtaacttcgtagtagaggtacggtaccgtattccgaccgttcctacgagacgaccgtaaccgccggtaagccgacttcctaacgtttacgtttcgacgtcgtaaggtacgtaacgaacccggtgaccggtaaggacgacggacccgggaagggaccctacggggtccttgttaaccttaagtttccgggttaggggtcggggtaagggttacggtaagtttcggggg

SEQ ID NO: 144511 - DNA, 598 bp, Homo sapiens
  misc_feature: GYAE6OF02IVZ3B.33.57.F02.1.454.CMB.1.raw
  modified_base (404)..(404): a, c, t, g, unknown or other
  misc_feature (404)..(404): n is a, c, g, or t
  modified_base (424)..(424): a, c, t, g, unknown or other
  misc_feature (424)..(424): n is a, c, g, or t
  modified_base (507)..(507): a, c, t, g, unknown or other
  misc_feature (507)..(507): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaaggtgtccagtgtcaggtgcaactggtggagtcgtgggggagacctggtcaagcctggagggtccctgacgactctcctgtgcagccgctggattcagtcttcagtgactactacagtgggctgggactccgacagggcctccgaagggggaacggggcgtagggagtgggtatttcagttcagtttaagtaactcggttcttcgccgtacccagacgtacctacttaagaatntgacaagtaactcgttaggngaggtacggccgtaagttcccgaaccgttcctccggaagaacggtaccaacggccgaagacgtcctactaactttatttacgngcagtatacgaacgacgctaggagacggaccggaggaccacgggtctcggttattagtttaggttggaggggtaggttacggaggttcggg

SEQ ID NO: 144512 - DNA, 582 bp, Homo sapiens
  misc_feature: GYAE6OF02F5UUC.33.57.F02.1.454.CMB.1.raw
  modified_base (302)..(302): a, c, t, g, unknown or other
  misc_feature (302)..(302): n is a, c, g, or t
  modified_base (469)..(469): a, c, t, g, unknown or other
  misc_feature (469)..(469): n is a, c, g, or t
  modified_base (521)..(521): a, c, t, g, unknown or other
  misc_feature (521)..(521): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctgggagggtccctgagactctcctgtgcagccgctggattcagtcttcagtgactactacatgggctggatccganaggctcgaggggagggctgggagtggtatttcgattcattagtattcggtctgctcccagcgtccattagaatatgcagtaatcgtggtagaggaggtcccgtattccgaccgttccgtaccaaggacgaaccaaccggtccgaagcgccttccaacttatttccgngccaagtactaacgaacctagcccgtaggacgacggacccggaagggaaccnccgggtattcggttacctttagtttacgtcgggtagggggaggttagggtaagttcggggg

SEQ ID NO: 144513 - DNA, 640 bp, Homo sapiens
  misc_feature: GYAE6OF02G3ABJ.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaacgtgggtggagtcgtgggggagaccgtggtcgaagccgtgggagggtccctgagacctctcctgtgcacgccgctggattcagtcttacagtgactactacagtgggtctggactaccgacgacggccgtaccggaagggggaacggggcgtagggtaggttgggtactttctacttctaatttaacgttaatcgttcttcgcctccgagtacgttacctaacttagtaatactcgactaaggtaactcgtggtaggacggagggccctagttacccgaccgtcctaaccgaaggtaaccgaacgaaccgccggaagtacctcctactactttacgtttcgagaccgtaagtacgtaacacgtaacgtcgtaggacgtacggaccggtaggaccgtcgtacgttgttacttagtttaggtggggagggtaggtaggtaggttcgggg

SEQ ID NO: 144514 - DNA, 552 bp, Homo sapiens
  misc_feature: GYAE6OF02G8NTH.33.57.F02.1.454.CMB.1.raw
  modified_base (346)..(346): a, c, t, g, unknown or other
  misc_feature (346)..(346): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaacgtggtggagtcgtgggggagaccgtggtcaagcctgggagggtccctgagactctcctgtcgcagccgctggattcagcttcgagtgactactacagtgggctggactccggacacggcctccgaggggagggctgggagtggtattcattnatttagtaatcgtctgctccagtactcacttagaatagtcgactaagtatctggtgacgacgggcctattccgaccgtccaccgagacgacctacggccgagcgctacagttcttccngtacgagatacgaacnggcctagacgacgccggaggaccgacgggtctgttactagtttcgttagggtgggtaggtgggaagttgggg

SEQ ID NO: 144515 - DNA, 762 bp, Homo sapiens
  misc_feature: GYAE6OF02HXNUG.33.57.F02.1.454.CMB.1.raw
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
tcagtacacacactcacgaccggtgctcgatttagctcgatatagtgagctctgggagaagagcccagccccagaattcccaggagtttccattcggtgatcagcactgaacacagaggactcacatggagtttgggctgagctggttttccttgttacaattataaaggtntccagtntcaggtgcaactggtggagtcgtgggggacgacctggtacaagccgtgggacgggtccctggacgtacctctccgttggtgcgacgccgtcgttgggtacttaccgaggtcctttacgaacggttggaacctttaacctaccgtaaggttcggggtaccggttaggaccgttacccggaaccgacgggtccggtacccgggaagggggaacggggtccgttaggggtaaggtttcggtattttccgagttttaccgtaagtttaacggttacttccggtttcgtttccgtccctttaccccggaaggtaacccggttaccctaaacgtttaacggaaattacgtacggactaaaggttaccttcggttagtacgggaacgtaccgggtccggttaactttccgacccggtttaccaccgtaaggaacgacccgtaaacggccgaaacggtctaccgtacttaacttacgttcgacgactagacgtagaacgcgtacgagacggtacggtcgggaacggacctaccggtctttacgttacgttacgttaggttgggttagggtacggtttgggtaagtttcggg

SEQ ID NO: 144516 - DNA, 723 bp, Homo sapiens
  misc_feature: GYAE6OF02IH3N5.33.57.F02.1.454.CMB.1.raw
  modified_base (222)..(222): a, c, t, g, unknown or other
  misc_feature (222)..(222): n is a, c, g, or t
tcagtacacacactcacgaccggtgctcgatttagctcgatatagttgggtttggggagctctgggagaagagccccagccccagaattcccaggagttccattcggtgatcagcactgaacacagaggactcaccatggagtttgggctgagctgggttttccttgttacaattataaaaggtgtccagtgtcaggtgcaactggtggagtcgtggggganccgtggtcaagcctgggacggtccctgagctctcctgtcgcacgccgctggtacttcagtccttcgagtcgactactacagtgggctggactcgacgaggcctacggaggggaacggggcgtacgggaggttggtattttccgaattcgtatttaacgttaagttccgttaccgttcgtccgttacccgaacggtacgttaccctaacgtttaagaaacttacgtggacctaaagttacttacggttcgtaggaaacgggtcgtaaccggactttacccgtacccggttaccctaacccggaacggtaaaccgaaacccgtaaacccggggaccctaaacgggtaccgtacccttaaccgtaacgtttacgttttacctacggtaacgtacgtaacgttaacgaacgtaccgtacccgtagggaacggaccggtaaccggaggtaccggacgtcgttaaggttctaagtttcggtagggtacgggtaggtaggttaacggg

SEQ ID NO: 144517 - DNA, 691 bp, Homo sapiens
  misc_feature: GYAE6OF02JETA8.33.57.F02.1.454.CMB.1.raw
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggtttcctgttacattataaagtgtccagtgtcaggtgcaactggtggagtcgtgggggacaccgtggtcaagccgtgggacgggtccctgacgactcgtcctgtgcacgccgntggattcagtcttcagtgactactacagtgggactggactccgganacggtcctaccgaggggaacgggctggggagtggactttcgattacgaagttagtaacttccggttcttcggcccttaccgaggtacgtccctaacgtttaaggaattagtcgactaaggtaacttccgtaggtgaacggtacggtaccgtattacccgacgttcccgtacgtaaggaccgtaaccgaaccgggaccgtaaggtacgtaccgttacgtaaccgtttacgtttcgtacggtactaacgttacgaaacggtaacgaacgggtcctaacgggaggtaaccggtaacccggaagggtaaacccgcggggtaaccttcggtaaccgtttaggtttaacggtcgggttaagggggaaccgtttgggaacggtttacgggg

SEQ ID NO: 144518 - DNA, 656 bp, Homo sapiens
  misc_feature: GYAE6OF02H5883.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtgggggagaccgtggtcaagccgtcggggggtccctgacgactctcctgtgcagccgctggattcagtcttcagtgactactacagtgggctggactccgacgaggcctaccggaggggacgggctagggagtggtatttcattcattagtaagtcgtcttgcctcctaggacgtacctaagtttaagaattacgtggactaagtaacttgtaggtaggacggtacggccgtaacttccgaacccggttctaccgaggtaacgaacccgaacggcccggaagtacgcccttacctaacgtttcgtttaccgtagaccgtaaggtaactacggtaaaccacggttcccgaggaacggcggtaccccgaaggggtaccaaccgggtcgttaacttacgttaagtttaggttcggggtaggggtaacgggttaggtaaggttggggttaacgg

SEQ ID NO: 144519 - DNA, 687 bp, Homo sapiens
  misc_feature: GYAE6OF02G52D2.33.57.F02.1.454.CMB.1.raw
  modified_base (560)..(560): a, c, t, g, unknown or other
  misc_feature (560)..(560): n is a, c, g, or t
  modified_base (584)..(584): a, c, t, g, unknown or other
  misc_feature (584)..(584): n is a, c, g, or t
  modified_base (602)..(602): a, c, t, g, unknown or other
  misc_feature (602)..(602): n is a, c, g, or t
tcagtacacacactcacgaccggtgctcgatttagctcgatatagtgagctctgggagaagagccccagccccagaattcccaggagtttccattcggtgatcagcactgaacacagaggactcaccatgggagtttgggctgagcgttgggtttttccttgttaacaatttaataaaaaggtgtccagtgtcaggtgcaactgggtcggagtcgtagggggagaccttggtacaagccgtgggacggtccctggacgactctccgtgtgcacggccgcgtggtattcgagtcttacgaggttacgaacttaaccacgtaggtcggggtctacgggtactacccggacgaaccgggtcccgtaaccgggaaggggggtaacggggcttaggggacggttggttacttttacgaactttacgtaagtttaagtaacttacggttctttaccggaccctcggtaacgtacgttacccctaaagttaacgtaatacgtacgaacgtaagtactcgtagaggacggtaggccgtatcccacgtcgtacgagtacaacgacccgngaacgcgactacgacttagttacngacgagtacgtacgaacngtcgagacgcggacgagggtaaccaggttcccgtataccgttaaggtttacgtcggggaagggtaggttaggtaagtttcggggg

SEQ ID NO: 144520 - DNA, 547 bp, Homo sapiens
  misc_feature: GYAE6OF02I7Y55.33.57.F02.1.454.CMB.1.raw
  modified_base (212)..(212): a, c, t, g, unknown or other
  misc_feature (212)..(212): n is a, c, g, or t
  modified_base (260)..(260): a, c, t, g, unknown or other
  misc_feature (260)..(260): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtcgtggggganaccgtggtcaagcctggagggtccctggagactctcctgtgcagccgntggattcagtcttcagtgactactacagtgggctgggactccgacgaggcctaccggaggggacgggctgggaggtggtatttcattcagttagtaactcgtctggcctcgagtctaccattagatntgacaagatcgtagtgagcggcctatcaccgtccncgagacgacgacgccgagcgtctacacttatttcgngtacgagtactagaacngccgtgacgcggacggacggtaccgcggtactgtcttaacgtttgtgggagggtaggtacggtagttcgggg

SEQ ID NO: 144521 - DNA, 668 bp, Homo sapiens
  misc_feature: GYAE6OF02JSOW5.33.57.F02.1.454.CMB.1.raw
  modified_base (162)..(162): a, c, t, g, unknown or other
  misc_feature (162)..(162): n is a, c, g, or t
tcagtacacacactcacgaccggtgctcgatttagctcgatatagtggagctctgggagaagagccccagccccagaattcccaggagtttccattcggtgatcagcactgaacacagaggactcaccatggagttgggctgagctggtttctgtacattanaaagtgtccagtgtcaggtgcaacgtggtggagtcgtgggggataccgtgggtccaagtccgtgggtacgggtcccctgacggtacttccgtccgttaggtcgctacggccgtcgttgggattaccggagtccttacgacgttgaaccgttacctaaccgagtacggggtccttagggacttacccggaacgtacggtccgtaccggaacgggggaaggggtcccttaggggagttggactttcagttcctaagttagtaactcgtactcgattcccgagtcgtaccctatttaacggattactggacaggactactgtagtagacggactagttccgaaccggttcctaccgaggtaccgaaacgaccgtccggaccgtagccctacgtaacctacgttcgcgtacacgattacgaagtaccgtcgacggagtcgaccggacggtaaccgcggaccttagtaccggttacgtagttacgggttaggacggtacggtagttacggg

SEQ ID NO: 144522 - DNA, 807 bp, Homo sapiens
  misc_feature: GYAE6OF02HFSC1.33.57.F02.1.454.CMB.1.raw
  modified_base (303)..(303): a, c, t, g, unknown or other
  misc_feature (303)..(303): n is a, c, g, or t
tcagtacacacactcacgaccggtgctcgatttagctcgatatagtgagctctgggagaagagccccagccccagaattcccaggagtttccattcggtgatcagcactgaacacagaggactcacatggagtttgggctgagcgttgggttttccttgttacaattataaaaggtgtccagtgtcgaggtgcaactggtggagtcgtgggggagaccgtggtcaaggccgtgggacggtccctggacgtactctccgtgtgcacgccgcgtaggacttcgagtcttcgagtctactacctanagtgggctggtactacccgacgaggccgtaccggaaggggagggcgtgggacgttggtactttcattactaagtttaagttaacgtcgttcgttcgccttacccgaggtactccgttaagttaacgaattacgtgaccgtaagtacgttacgtgtacgggtaacggacggtacgtacgttcccgtaacccgttcgtaccgaacggtaacggaaacccgtaaccgggccggtaacggtaccgtacccgttaccgttaaccgtttaccgttttaccgtaaccggtaccgtaaaggtttaacgttaaccggaaaccgtaccggttaacccggtacgggtaaacccggggaccgggttaaccccggggaaacgggtaacccccggtttaacggggtaccccgttttacgggttttaaccctttttaaagggttttttcgggttaaccggggggttaacggggggggtttaacgttttaggggggtaaaggtttttttaacgggggggg

SEQ ID NO: 144523 - DNA, 759 bp, Homo sapiens
  misc_feature: GYAE6OF02HKAX2.33.57.F02.1.454.CMB.1.raw
  modified_base (174)..(174): a, c, t, g, unknown or other
  misc_feature (174)..(174): n is a, c, g, or t
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
  modified_base (602)..(602): a, c, t, g, unknown or other
  misc_feature (602)..(602): n is a, c, g, or t
  modified_base (625)..(625): a, c, t, g, unknown or other
  misc_feature (625)..(625): n is a, c, g, or t
tcagtacacacactcacgaccggtgctcgatttagctcgatatagtgagctctgggagaagagcccccagccccagaattcccaggagtttccattcggtgatcagcactgaacacagaggactcaccatggagtttgggctgagcgtggttttctgttacaattataaaggtntccagtgtcaggtgcaactggtggagtcgtgggggnacgtggtcaagcctgggacggtccctgagactcctccgtgtgcncgccgcgtaggtattcaggtccttcaggtacgtaacctactaacaggttcggggctacgggactcccggaccagggtccttacccgggaagggggtaacgggggcgtaggggtaggttcgggtaactttcgaacttttacgtaagttttaacggttaagttccggtttcgtttaccggacccgttacccgaaagggttaccgttaccctaagttttaacggaaattacgtacggtaccgtaaaggtaacttcgttaggtaagggtaacggacggttaccctacgtttacccgtacccggttacctacccggaagtaacggaacccgtaacgggacccggaggtaaccncctacgttaacgtttctttaccncgtacgaagtcgtaacgtaaccacgttaccgagggagacccgggtacggtaaggacccggttacgggtcgttaacggtactttacgtttagggttacgggaacgggggtttagggtacggttaaggttgggggg

SEQ ID NO: 144524 - DNA, 704 bp, Homo sapiens
  misc_feature: GYAE6OF02JCQAB.33.57.F02.1.454.CMB.1.raw
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
tcagtacacacactcacgaccggtgctcgatttagctcgatatagttgggtttggggagctctgggagaagagccccagcccccagaattcccaggagtttccattcggtgatcagcactgaacacagaggactcaccatggagtttgggctgagctgggtttcctgttacaattataaaaggtgtccagtgtcaggtgcaactggtggagtcgtgggggagacctggtcaagcctggagggtccctgagactctctgtgcngtcctcgtggnttcaccttanagttactatggcatcgcacgtcgggtccgccgaggcctccgacgggcgaaggggtctacgggagtcgggcttagtctaagttacatccacattggaattaagtaaaaattaaacgtacttagtacggtacggtaaccttaccgggtaggaacgggtcccggttaattccgaagaccgtattcccgtaacgaacggtaaccggtaacctaaaccgtttaaccgaaaacgttaacccgtaacggtttcgtaaacgttcgtacgtaacttaaagtccgggtaaaacggttgggaccgtaacgaacccgtaggaacccgtacgtaccgggtggtttacggttacgttacgtttaccgtgggtacgtaaccggtaaagttaccgttttaaggttacgaacggtttagttaacggttgttaaacggg

SEQ ID NO: 144525 - DNA, 847 bp, Homo sapiens
  misc_feature: GYAE6OF02I14TY.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggtttttcctgttacaattaataaaaggtgtccagtgtcaggtgcaactgggtggagtcgtgggggagaccgtggtcaaggccgtgggacgggtcccctggacgtaccttcctcccgttggtcgcgacgcccgcgtggtacttcgacgtccttcgaggtcgtaacctacgtacgtagtgggtctgggacttcccggacgacgggtaccgtccggaaggggggaacggggtcgtggggtaaggttacgggttattttccgaagttttacgttaagttttaaacggttaaacgttccgggttttacctttcggtcccgttaccccgtaaggttaccgttaccccgttaaacgttttaaagaactttaacgtcgaaccgaaggttacttcggtttaggacgggtaacggaccgggttaccggtactttcccggtaaccccgtttcccggtaacccgagggtaaccgaaccccgtaaaccggggccgaaaggtccggtaccctttaacccgtaacgtttttaccgttttacccgacgggtaacctagggtaaccttaaacgggaacccttaacgggcccgttaggaaccggccggtaacccggggaaccggtaaaccggtccgggttacctttagggtttacctttaagggtttcgggttacggggtgggggttaacgggtttagggtaacggttttgggggg

SEQ ID NO: 144526 - DNA, 697 bp, Homo sapiens
  misc_feature: GYAE6OF02IN6V9.33.57.F02.1.454.CMB.1.raw
  modified_base (303)..(303): a, c, t, g, unknown or other
  misc_feature (303)..(303): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacattataaaaggtgtccagtgtcaggtgcaactggtggagtctgggggagacctggtcaagcctggacgggtcctggagacctctcctgtcgcagccgctggattcgagcttcagtgactatacatgggctaggactccgganaggtctaccgaaggggacgggctagggacgtggtatttcagttcatttagtaactcgttcttgctacccgagtacgtacctaagttaacgaaatacgttgacctaggtaaacttcgtaggtagacggtacggacccgtattcccaaaccggttcccaccggaagtacggaacccaaaccgggtcccgaaaggaccggttctaccccgtaaagtttaacttttccggtcgaaacgtaacggggtaaactttccggggaaaacccttaaggcccggtttaaggaaggacccggtaacccggggaaggtaaccccgtggggaaccctttgttaacccggtttaagtttaacgggttccggggtaagggggtaacggttacgggaacgggtttacggg

SEQ ID NO: 144527 - DNA, 802 bp, Homo sapiens
  misc_feature: GYAE6OF02FWKMG.33.57.F02.1.454.CMB.1.raw
  modified_base (251)..(251): a, c, t, g, unknown or other
  misc_feature (251)..(251): n is a, c, g, or t
  modified_base (470)..(470): a, c, t, g, unknown or other
  misc_feature (470)..(470): n is a, c, g, or t
tcagtacacacactcacgaccggtgctcgatttagctcgatatagtgagctctgggagaagagccccagccccagaattcccaggagtttccattcggtgatcagcactgaacacagaggactcacatggagttggctgagtcttgggttttccttgttacaattataaaggttgtccagtgtcaggtgacaacgtggtggagtcgtggggacgaccgtggtcaagccgtgggacggtccctgacgactcnctgcgcacgccgtcgtggattcgagtcttcaggtcgtaacctactactagtgggacgtaggtaccgtccgacgaacggtcccgtaccgggaagggggtaaccggggtcgttaggggacggttagggtacttttacctagttttaccgtaaggtttaagtaaccgttcggtttcgttacgtacccttacccggaaggtaccgttaccctaaggtttaaanaacgtttacgacgaaccgtaaagtaacggtttaccgtgggttaaccgggacggttaaccgggtaccccgttaaacgtttacccgtaaccccggttccgtaaacccggtaagggtaaaccggaccccgtaaaaacccgggtcccgggtaaacgtacccgtaccgttaaacccgttaaccgtttacgtttaccgtcgtaaaccgtacgttaacgttaaccgaaacccggttgacccggttaggaacgaccgggtaacccggtaggaacccgtacgtaccgttacgttagttaacggttggttaggggtagggttacgggtagtagggtttcggg

SEQ ID NO: 144528 - DNA, 607 bp, Homo sapiens
  misc_feature: GYAE6OF02FM9LP.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtgggggagacctggtcaagcctggagggtcccctggagactctccgtgtgcagccgctggattcagcttcagtgactactacagtgggctggactccgacgacggctccggaaggggaacggggtcgtgggaggttggtattttccatttctaatttagtaattcggttcttgcctcccgagtactcccaatttagaatagtcgacgagattctgtggagacggtccgtattccaccgtctaccgagacgaccaaccggccgagacgctactacttactttcgacgacagtagtagaaccgtagtacctacgggacgtacggaccgggaacggaccgacgggtcgttacgttacgttactttaggttcgggttagggggtaggttagggtaaggttcgggg

SEQ ID NO: 144529 - DNA, 557 bp, Homo sapiens
  misc_feature: GYAE6OF02HBKVR.33.57.F02.1.454.CMB.1.raw
  modified_base (214)..(214): a, c, t, g, unknown or other
  misc_feature (214)..(214): n is a, c, g, or t
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
  modified_base (447)..(447): a, c, t, g, unknown or other
  misc_feature (447)..(447): n is a, c, g, or t
  modified_base (510)..(510): a, c, t, g, unknown or other
  misc_feature (510)..(510): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtcaggtgcaactgggtggagtcgtggggganaccgtggtcaagccgtggacgggtccctgagactctcctgtgcgagccgctggattcgagtcttcagtcgactactacagttgggctgggactccganacgggtctccggaggggagggctgggagtggatttcattcattagtatcgtcttgctccagtactccatagaatntgacagattcgtgtagagacggtcctattccgaccgtcaccgaagacgacacgccgagcnctcattacttcgagctagattacgaactcgaccttggacgacggcccggtaaggacgacggtnttacggtacttagttacggttggtaggggacgttaggtaagttgggg

SEQ ID NO: 144530 - DNA, 671 bp, Homo sapiens
  misc_feature: GYAE6OF02FKQ20.33.57.F02.1.454.CMB.1.raw
  modified_base (261)..(261): a, c, t, g, unknown or other
  misc_feature (261)..(261): n is a, c, g, or t
  modified_base (510)..(510): a, c, t, g, unknown or other
  misc_feature (510)..(510): n is a, c, g, or t
tcagtacacacactcacgaccggtgctcgatttagctcgatatagtggagctctgggagaagagccccagccccagaattcccaggagtttccattcggtgatcagcactgaacacagaggactcaccatggagtttgggctgagctgggttttccttgttacaattataaaaggtgtccagtgtcaggtgcaactggtggagtcgtggggagacctggtcaagcctggagggtccctgagactctcctgtgcagccgcgnggattcagtcttcagtgactactacagtgggctggactccggacaggcctccggaaggggaaggggctagggagtgggtatttcgagttcattagtaatcgtacttgcctcccgagcgtacctaattacgaaatgtgacgtaagaacttcgaggtggaaggacgggtaccgtagttcccgaaccgttcgtaccgtaaggacgaaccgaacggccggaagtacgccttacgtaaccgttatttttaccgngtaccgtaagtacgttacggaaaccgacgtcccgttagggacgtaccgggtaaccgggaaacggggtaacccgaacggggttccgttacggtttaacgtttaacgtttaaggttttcggggtaaggggggtaacgggtttaggggtaaaggtttacggggg

SEQ ID NO: 144531 - DNA, 772 bp, Homo sapiens
  misc_feature: GYAE6OF02F3CLC.33.57.F02.1.454.CMB.1.raw
  modified_base (270)..(270): a, c, t, g, unknown or other
  misc_feature (270)..(270): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcgttgggttttccttgttactaattaataaaaggttgtccagtgtcaggtgcaactgggtggagtcgtggggagacctggtcaagcctgggacggtccctgacgtactcctcctgtcgcaggccgntaggatcgagtcttcgtagtcgacctactacgagtgggctaggactaccggacgacggcctaccgggaaggggagggcgtagggagtaggtattcgtagttcaggtttagaagttccgtcttcgacctcccgaagtacgttaccctaagtttaacgaattagtacgaacgtaggtaacgttcgttaggtacgggtacgggtacggtccgttaaccgtttaccgtaacccggtttcccaccggtaacggtaaccgtaacccgaacccgggtaccgaacgtaccgttaccggtaaccccgtttacgtttaaccgttttcggtaccgaacggttaacgtaccgtaaacggtaaaccgttaccggaaccgtagggaaaccgaccgggaacccgggaccgggtaaccgttaaccggggtccgttaaacggttttacgttttaggttttaaccgggttaggggttaacgggggttacgggtttacgggtaagggggttttaaccgggg

SEQ ID NO: 144532 - DNA, 657 bp, Homo sapiens
  misc_feature: GYAE6OF02IGENM.33.57.F02.1.454.CMB.1.raw
  modified_base (411)..(411): a, c, t, g, unknown or other
  misc_feature (411)..(411): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctggttttccttgttacaattataaaaggtgtccagtgtcaggtgcaacgtgggtggagtcgtgggggacgaccgtgggtacaagccgtgggacgggtccctgagacctctcctgtgcacgccgctggattcgagtcttcgagtgactactacagtgggctggactccggacgacggcgtaccgaggggacgggcgtgggagtggtatttcattctaagttagtaacttcgtacgttgcctccgacgtcgtacctaagttagaaatntgactaagtaactcgtggtgaaggtacggaccgtacgttccgtacccgtcgtaccgaacgaacgaccaaccggtacccgtaaggacgtacctactaacgtttacgttttaccagtacgtacgtagtaacgtaaaccgcgtaccgtagggacgtacggacccggaaaggacccgtacggtaaccgttcgttaaccggtttattttacgggttagggttcggggtaagggttcggtaaggtttcgggg

SEQ ID NO: 144533 - DNA, 843 bp, Homo sapiens
  misc_feature: GYAE6OF02I306T.33.57.F02.1.454.CMB.1.raw
tcagtacacacactcacgaccggtgctcgatttagctcgatatagttgggtttggggagctctgggagaagagccccagccccagaattcccaggagtttccattcggtgatcagcactgaacacagaggactcaccatggagtttgggctgagctgggtttccttgttacaattataaaaggtgtccagtgtcaggtgcaacgtggtggagtcgtgggggacgaccgtggtcaagccgtgggacggtccctggacgacgtcctccgtgtcgcacgccgcgtggacttcgagtcttacgtacgtgtaaccttactactagttacggggtctacgggaacctcccggaacgacggtacccgttaccgggaacgggggtaaacgggggccgttagggggtaaggttccgggtaagttttaccgtaacgtttacgtaaacgtttttaacggtaaacgtttccgtttaccgttccggtcccgttacccgaaggtaaccgttaccctaaacgtttaaagtaaacgttacgtacgaacgtaaagtaaacgtttcgtaggtacggacggtaccggtaccgttaacgttacccgaccccgttctaacccggaaggaaccgtaaacccgtaaccgggaaccggtaacggaccgtccgttaaaccgttaccgtttaaccgtttccgtaggacccggttaaagtaccggttaaacggaacccgttaacggtaccccgtagggtaaccgtaaccggggtccccggaaaggggttaacccgaacccggggttcgtttaccgtttaaccgttagtttaagggttccgggtaaggggtacgggttaaggttaacgggg

SEQ ID NO: 144534 - DNA, 658 bp, Homo sapiens
  misc_feature: GYAE6OF02JKWBL.33.57.F02.1.454.CMB.1.raw
  modified_base (368)..(368): a, c, t, g, unknown or other
  misc_feature (368)..(368): n is a, c, g, or t
tcagtacacacactcacgaccggtgctcgatttagctcgatatagtgagctctgggagaagagccccagccccagaacttcccaggagtttccattcggtgatcagcactgaacacagaggactcaccatggagtttgggctgagcgttgggttttccttgttacaattagtaaaggtgtccagtgtcaggtgacaacgtgggtggagtcggtgggggacgtaccgtggtcaagccgtgggacgggtccctgagtacctcttccgtgtcgcgacggccgtcgtggtacttcgagtcttcgagtcgacttactacagtcgggctggactccgacgacggtccgtacggaagggggacgggtcgtagggnggttacggtactttcgtattcaagtttaagtacgttcgttcgttacgccctaccgaagtacgtacctaagttaagaattgtacgactaagtaacttcgagtaggtacgacggtctacttccgtaccttacgaccgaaggaaccgaccgtaaccgggacgtataccgaccttactacgtttacgttccgagtacgaagtgtaacgaacgctaccggagacggcggacggtacggacgacggttctaagttccttaggtttacggtgggaagggttaggaggttaggttggg

SEQ ID NO: 144535 - DNA, 689 bp, Homo sapiens
  misc_feature: GYAE6OF02GMXFN.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatgggagtttgggctgagctgggttttccttgttacaattataaaggtgtccagtgtcaggtgcaactggtggagtcgtgggggagacctggtcaagcctgggacggtccctgagactctcctgtgcagccgttggacttcagtcttcagtcgactactacagtgggctggatccggacagggcctccggagggggacggggcgtgggacgtgggactttcgattcgtagtttaggtaaattcgtacgttcgcttcccaagtaccgtccctagtttaggaattagtcgactagtaatcgtagagtaggaacgggtccaacttcccgtaccgtccgtaccgacggtaacgaaacgtacccggaccggagaacgtccttaacgacctttacgttctacgggtacctaggtactacgtaaccaaaggtcccgttagggaacgacgggacccggtaaagggacccgaacccggggttattccggttacgtttaagttttacgggtttacgggggttaaggggaacggggttttacggggtaaccgtttaggggggtttaaccgggg

SEQ ID NO: 144536 - DNA, 1085 bp, Homo sapiens
  misc_feature: GYAE6OF02FKS25.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtccagtgtcaggtgcaacgtggtggagtcgttggggggagaccgtgggtaccaagcccgtagggacgggtccctggacgtaccgtcctcctggtcgccacggtcccgtcgtacggactttacgaacggtcctttaccgaaggttacggaaccttaacctaaccgtacggttaggggggtcttagggggtaaccgttacccggaacgtaaccgggggtcccctaacggaaacgggggggtaaacgggggggccgtttaagggggaacgggtttacgggttaacttttttaccgtaaagttttaccgttaaaaggtttttaaacggttaaaccgttacccgggttttccgttttaaccggtaccccgtttaacccccgtaaaggggtttaaacccggttaaccccccgtttaaaacgttttaaaaggggtaaacccgtttaaagttccgggtaaacctaaccggggttaaaacttttccgtttaaggggttaaaccgggtaaacggggtaaccgggggttaaaccccttcggttttaaacccccggtaccccgtttaccccggttaaacccggtaaagggttaacccggaaaaccccgggtaaacccggtaaccccggggtaaaggtaaacccggttcccttaacccggtttaaaaccgtttttcccgtttttaacgggtaccgtaacccggttaaagggttaaccctttaaaccggggaaaaccgtaccgggttttaccccggaacgggtaccgggtaacgggtaacccccggggtaaacgggtacccggggtaaacccgggtttcccggtttaacggtttaacccgtttttagttttaaccgggtttacggggggttaacggggtttaacgggggtttaacggggttaaggggttttaaccggggggg

SEQ ID NO: 144537 - DNA, 697 bp, Homo sapiens
  misc_feature: GYAE6OF02HP92T.33.57.F02.1.454.CMB.1.raw
  modified_base (589)..(589): a, c, t, g, unknown or other
  misc_feature (589)..(589): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaggtgtccagtgtcaggtgcaactggtggagtcgtggggggagacctggtcaagcctgggacgggtccctggagactctcctgtgcagccgctggattcagcttcagtgactactacagtgggctggactccggacacggcctccggaaggggacggggcgtagggaggtggtatttcattcattagtaactcgttcttgcctacccgagtaccgtaccctaacgtttaagaactacgttagacgtaacggtaacttccggttagggtacggtagggaccggggtacccgttaagtttcccgtaaccccgttccgtaacccgtaaggaaccggaaccgaaacccgggtccccgggaagtaaccggtcccttaccgtaacttttacgttttccgagtaccgtaagtaacgtacggaaacncggtacctagggacgaccgggaccggaacggacccgtacggtccgttacgttaccgtttagtttacggtaggggttaggggtaacgggttagggtaagtttacggggg

SEQ ID NO: 144538 - DNA, 692 bp, Homo sapiens
  misc_feature: GYAE6OF02H76UD.33.57.F02.1.454.CMB.1.raw
tcagtacacacactcacgaccggtgctcgatttagctcgatatagtgagctctgggagaagagcccagccccagaattcccaggagtttccattcggtgatcaagcactgaacacagaggactcacatggagtttgggctgagctgggttttccttgttacaattagtaaaaggtgtccagtgtcaggtgcaacgtggtggagtcgtgggggagacctggtcaagccgtgggacggtcctgagtacctctctgtcgcacgccgctggacttcagtccttagcgtagaacttactacaggtacggtcgtaggtactccggaactagggcctaccggaggggaacggggtctagggacggtggtactttacgacttactaagtttacgttaacttccggttcttcggcccgttaccccgaaggtaaccgtttcccgtaaagtttaagaactttagtacgacggtaacgtaagttcgtaggtacggaggacggtaccgtattcccgaccgttaccgtacgaacggtacgtaacgaaccggtccggaagacgacttactaccgtttagttcgtacgagacgtagtacgaaccgtagtaccgtagacgacggtaccggacggtaacccggacggtaacgttacggtaccttaagtttacggttagggaacgggtaacggttagggagtttacggggg

SEQ ID NO: 144539 - DNA, 771 bp, Homo sapiens
  misc_feature: GYAE6OF02H9HJM.33.57.F02.1.454.CMB.1.raw
  modified_base (273)..(273): a, c, t, g, unknown or other
  misc_feature (273)..(273): n is a, c, g, or t
tcagtacacacactcacgaccggtgctcgatttagctcgatatagtgagctctgggagaagacgccccagccccagaattcccaggagtttccattcggtgatcagcactgaacacagaggactcacatggagtttgggctgagctgggttttccttgttacaattataaaaggtcgtctagtgtcgaggtgcacgtggtggagtcggtgggggacgccgtggtacaagccgtagggtacgggtccctggagtacctctcgtcgtgcagccgntggtatccgagtcttcgagtacgtactaactagaggtggtctgacgtccacggaggccgtcggaacgggggagggtctaggggtacgtggtaacttttccgacgtttatagtttaacgtaaccgttcgtttacgtcgtacccgtaccgaagtaccgttcctaagtttaagaaacgttgacgtcgtaaacgttaactcggtacggtagtaacgggtacggtccgttaacgttaccccgtacggttccgttaccgaaacggaacccgtaaccgaaccggttaccggaacgacgttaaacccgttcccttaaacgttttacgtttccgtacgctaaacgggttaacctaaccggtaaccgccgggttaaccgaaggacggggtaaccgacccgggaacgtaaccccgggtagggggtacccctttttagtaacccggttttagtttacggggttgggggttaaccgggggttaggtttaaggggtacggttttaacggggg

SEQ ID NO: 144540 - DNA, 720 bp, Homo sapiens
  misc_feature: GYAE6OF02HNK7K.33.57.F02.1.454.CMB.1.raw
  modified_base (601)..(601): a, c, t, g, unknown or other
  misc_feature (601)..(601): n is a, c, g, or t
tcagtacacacactcacgaccggtgctcgatttagctcgatatagtgagctctgggagaagagccccagccccagaattcccaggagtttccattcggtgatcagcactgaacacagaggactcaccagtggtagtttgggctggagtcgttgggttttccttgttacaattaataaaggtcgtaccagtgtacaggtgactaacgtggtcggagtcggtagggggataccgtaggtacaacgccgtgggacgggtccctaggacgtaccttccgtctgtacgcgacgtccgcgtggtacttcgagtcttacaggtctaacctactacaggtacggtactcgacttaccggacgacggccgtacgggacggggacgggcgtagggtacgtaggttacttcgtacgttagtagttaagtacgttcggttattccgccttacccgtagtaccgttacctaataagtatacggtagacctaagtactggtacgtacgggtagtaccgggtacttaccgtaaccgtacccgttacccgagtaacggaccgtaacccgaacccggtaacgacgtacctacttaaccgttcttacgttacgacgtanacgtaatacggtaacgtcgtaactcggacggtaccggacggaaccggaccgtacggtacttacgttagtttaacggttcgttagggggtacgggaggtttaacggtgggttttaacggg

SEQ ID NO: 144541 - DNA, 628 bp, Homo sapiens
  misc_feature: GYAE6OF02GLOV9.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagttgggctgtgcttggttttccttgtttctgtcctagaggtgtccattctgttgtgcagcgtggtggaggtcggggggaggtcgttgggtaccggccggggggtctcgtaagctctctgtgcacgcctcggatcagtacttcacctagtcgtttcggccttccgacgttcgggtcccgccgtacggtccgttccggtagggggacgggtccgtgggtacggtggcgttgtctatgtcgtcttcgtggtaggtgtagtcggtcgtcgttcttcgtacggcggtactcgtggtcgggacgggtccgtattcgacgtacctaccgtcgagtaacgaactaaccgacctaaacctaccgtcccgtgacctactaccgtcagtactacggaaccacgtgaccgagaccggacgacgccggtactaagtattacgtacgtggtacgcgaacgtaccgtaacttagtacggactacggtacgttcgggtcgggtggtcctcgg

SEQ ID NO: 144542 - DNA, 763 bp, Homo sapiens
  misc_feature: GYAE6OF02FU6BO.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtccagtgtcaggtgcaactggtggagttcgtggggggagacctgggtacaagtccgtgggacgggtccctggacgactctcctgtcgcacgccgcgtggtattcagtcttcagtcgactacgtacagtgggctggactccggacgaggtccgtaccggaagggggagggtcgtagggtaaggttggtaatttccgaattcgtaagtttaacgttaatccggttcgttcgcctaccccggaaggtacgtaccctaagtttaagaaacttagacgttaacgaacggttaacttcgttaggtaggtaagggtaccgggttaccctaaacggtttccccgtaaacccggttccgtaaaccccggtaaggaaccggtaaaccgtaacccgggcccgtaaagtaccgggcccttaaccgtaacctttacgttttccgtacgacgttaaaggtaccttaccgaaactccgggtaaccttgggaagtaccgggaccgggtaacggtaaacccggacgggttccttacggtttaaccttacggttttaaggttcgggtaagggggtagtttaaccggggagggttttacgggggg

SEQ ID NO: 144543 - DNA, 795 bp, Homo sapiens
  misc_feature: GYAE6OF02HZXJQ.33.57.F02.1.454.CMB.1.raw
  modified_base (217)..(217): a, c, t, g, unknown or other
  misc_feature (217)..(217): n is a, c, g, or t
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (652)..(652): a, c, t, g, unknown or other
  misc_feature (652)..(652): n is a, c, g, or t
tcagtacacacactcacgaccggtgctcgatttagctcgatatagtgagctctgggagaagagccccagccccagaattcccaggagtttccattcggtgatcagcactgaacacagaggactcacatggtagttgggctgagctgggttttccttagttaacaattaataaaaggtgtaccagtgtcaggtcgacaacgtggtgagtcgtgggganaccgtggtcaaggcctagggaggtcctgagacctctcctgtcgcgacgccgtntggacttcgacgtccttanagtacgactactacgagtcgggcgtagacgtccgacgtacggaccgtccgagggggaacgggtcgtgggaaggttggtactttagagtttacgtaagtttaagttaacgttcgtttacttacggacccttaccgaagtaaccgttacctaacgtttaagaatttacgtacgacgtaacgtaagttcgaggttacgggacgtacgggtacccgttaattcccccgtaaccggttaccctaaccggtaaggaaccggttaaacccgaccgggtaaccccggaaggtaccccgttccctaacccggtttaaacctttcggttttaaccccaggtacccgtaacgggactttaaaccgggaaacccnccggttaacgtaagggacccgtaacggggtaacccgggaacgttaccccgggtagggttaaccttacgggtttaaccctttggggttttaaaccggttgggggttaacgggggacggtttacggttaaaccgggggttttggg

SEQ ID NO: 144544 - DNA, 593 bp, Homo sapiens
  misc_feature: GYAE6OF02IRPBT.33.57.F02.1.454.CMB.1.raw
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
  modified_base (471)..(471): a, c, t, g, unknown or other
  misc_feature (471)..(471): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttcctgttacaattataaaaggtgtccagtgtcaggtgcaactggtggagtctggggganacctggtcaagcctggagggtccctgagactctcctgtgcagccgntggattcagtctcagtgacctactacagtcgggctgggatcccgacgaggtcctaccgaaggggaacgggctgggagtggtatttcattcgattagtaatcgtctgcctaccgagtactccattagaatgtgatagtatcgtgtagagacgacgtattcgaccgtccgtaccaggtacacgaacgccgaagacgtcctactaccttatttccgngacgtagtaagtacgaacaacggccttaggagacggtacccgggaaggtaaccgacggttaccttacggttacttaagtttacggttggggtacggggtaaggttacgggtaagtttcgggg

SEQ ID NO: 144545 - DNA, 781 bp, Homo sapiens
  misc_feature: GYAE6OF02ISP2L.33.57.F02.1.454.CMB.1.raw
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
tcagtacacacactcacgaccggtgctcgatttagctcgatatagtgagctctgggagaagacgccccagccccagaattcccaggagtttccattcggtgatcagcactgaacacagaggactcacatggagtttgggctgagctgggttttcctgttacaattataaaaggtgtccagtgtcagggtcgcaacgtggtggagtcggtgggggacgaccgtaggtcaagccgtgggacggtccctgagtacctctacgtgtgcgacgtcgtgtggattacgagtcttacgagtagtactaactanagtcgggtactggactccggaacnggacccgtacggaaggggtacgggtacgtagggaggtttaggtactttagtactttacgtaacgtttaagttaacgtcgtttaccgttaggtacccttacccgtaaggtaacccttacccgtaaagtttaacggtaaaagttctacgtaacgtaaagtaacgttcgtttacgggacgggtaaacgaccggggtacccggttaactttccccgttaacccgttcccggtaaacccgtaacggaaaccggtaaacccgaacccggaccgaaacggtaaccgtcccttaacgtaaccgttttacgttttacggcggtaaaccgtagtaaccgtaacgaaacccgtaacggtaccgttagaccggacggacccggaaggtaccggacccgttcgttacggttactttaggttacggttacgggtaggggttaagttacgggggtacgtttagggg

SEQ ID NO: 144546 - DNA, 724 bp, Homo sapiens
  misc_feature: GYAE6OF02H611E.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcacatggagtttgggctgagctgggttttccttgttactaattaataaaaggtgtccagtgtcaggtgcaactggtggagtcgtgggggagaccgtggtcaagccgtgggacgggtccctggagtacctcgtcctgtgcagccgctggattcagtcttacagtgaactactacagtgggcgttggactccggacgaggcctccggaaggggaacggggcttagggacggtggttatttacgagtttacgtaagtttaagtaacgttccgttcgttcgtacctccccgtagtaccgtacccttaacgttaagaaacgtttaagtcgaacctaagtaactttacgtaggttaggaacggacgggtacccttacgttacccgtacccggtaccttacccgaacggaacgaacccgtaaaccggacccgaagggtacgtacccttacgttaaaccctttagtttctacgaccgaagtacgtaacggacgtaaccgtacgtacggaacggtcggacccgggtaaggtacccgacgggtacgttacgttaacgtttagttacgggtttgggtacgggggtagggtttaacggtaggtttaacggggg

SEQ ID NO: 144547 - DNA, 646 bp, Homo sapiens
  misc_feature: GYAE6OF02F89IU.33.57.F02.1.454.CMB.1.raw
  modified_base (176)..(176): a, c, t, g, unknown or other
  misc_feature (176)..(176): n is a, c, g, or t
  modified_base (368)..(368): a, c, t, g, unknown or other
  misc_feature (368)..(368): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtntccagtgtcaggtgcaactggtggagtcgtgggggagaccgtggtcaagcctggacgggtccctgagactctcctgtgcagccgctggattcagtcttcaggtgacttactacgagtgggctggactcccggaacagggcctaccggaagggggaacgggctgggagtggtatttcattcattagtatcgtntcgcctccgagtacgtccattagaatgtgactagaacttcgtaggtaggaagcggtcctaatttcccgaccgttccacgtaaggaacacccgtaacggcccggaaagcctccttactaacttctttccgagtacaggtaataccggaaacgtgtacccgtaggacggaccgggtaccggaaacggggtacctacccggggtatttaccgggttaacctttaggttttaggttccgggggtagggggtttaacggttacggggttaagtttacgggggg

SEQ ID NO: 144548 - DNA, 681 bp, Homo sapiens
  misc_feature: GYAE6OF02GRYUM.33.57.F02.1.454.CMB.1.raw
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (444)..(444): a, c, t, g, unknown or other
  misc_feature (444)..(444): n is a, c, g, or t
  modified_base (567)..(567): a, c, t, g, unknown or other
  misc_feature (567)..(567): n is a, c, g, or t
tcagtacacacactcacgaccggtgctcgatttagctcgatatagtgagctctgggagaagagccccagccccagaattcccaggagtttccattcggtgatcagcactgaacacagaggactcaccatgggagtttgggctgagtcgttgggtttttccttgttacaatttaataaaaggttgtaccagtgtcaggtgcaactggtggtagtcggtgggggagaccgtggtcaagccgtgggagggttccctgagacctctcctggtgcncgccgntggtattcagtcttcngtgactactacngtcgggctaggacgtccgacgacggtccgtaccggaagggggagggtcggtagggtaggttggtatttcgtattacgtaatttaactacgtcgttcgttcgcccgttaccgagtacgttacctacgttaaagattacgngacgtaagtatcgtaggtacggagacggtccgttaccgttaccgtacccgttacccgtaccgaaaggtaccgtaaacccggaaccggaccggtagtaccgtctaacccgttattctttaccgnacgtagtacgtaagacctacgacgtagggacgaccgacgggccggaacctcgggtacttacggttactttacgttagggttacgggttagggggatttagggaggtttacgggg

SEQ ID NO: 144549 - DNA, 792 bp, Homo sapiens
  misc_feature: GYAE6OF02GUN5A.33.57.F02.1.454.CMB.1.raw
  modified_base (218)..(218): a, c, t, g, unknown or other
  misc_feature (218)..(218): n is a, c, g, or t
  modified_base (352)..(352): a, c, t, g, unknown or other
  misc_feature (352)..(352): n is a, c, g, or t
tcagtacacacactcacgaccggtgctcgatttagctcgatatagtggagctctgggagaagagtcccagccccagaattcccaggagtttccattcggtgaatcagcactgaacacagaggactcacatggagtttggctgagctgggtttccttgttacaattataaaaggtgtaccagtgtcaggtgctaactgggtggacgttcgtgggggganaccgtggtacaagtccgtgggtacgggtacccctggacgtaccgtcctccgttgtgacctacgccggtctgggacttcgaggtccttccgaaggtcgactaccttagagtgggtcctagggtactcccggacgngggtccgtacccggaagggggggtacgggtaccggttaggggaggttacggggtacttttccgtaacgttttctaacgttttaaggtaaacgtttcgggtttacccgttttacggaccccgtttaccccgtaaaggggttaaccctttaccgtaaacccgttttaaaggaactttagtaccgggtaacctaagggttaacttcggttaagtcgggtaaacgggtcgggtaaccttcgtaccgtaccgtcccgtaacgaggtaacgaccaaccgggtcgaagtactctactacttacttacgtgaccgtaagtacgtaaggaccgtaacgtccgtacgggacgaccgggtaccggaacgggtaccgtaaccgggttccttaggttaacccgtttagttagggttcgggtgggttaaccgggttagtacccggggtttaggg

SEQ ID NO: 144550 - DNA, 798 bp, Homo sapiens
  misc_feature: GYAE6OF02G6UFK.33.57.F02.1.454.CMB.1.raw
  modified_base (476)..(476): a, c, t, g, unknown or other
  misc_feature (476)..(476): n is a, c, g, or t
  modified_base (536)..(536): a, c, t, g, unknown or other
  misc_feature (536)..(536): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcgttgggttttccttgttactaattataaaggtgtccagtgtcaggtgcaacgtggtggagtcgtgggggagaccgtggtacaagccgtgggacgggtcccgtgagtacctctcctggtgcgacgccgtcgtggtacttcgacgtcctttacgagtacgtaaccttactacaggtcgggctaggactccgacgacggtcctaccggaaggggacgggacgtagggaggttacggttacgttttccacgtttactaagtttaacggttaacttcgggtttcttaaggtcccttaccgaacggtacgtacccgttaagtttaacgaattacgtnaacgtaatacgttcgttcggttaggaacgtccggtaccgtaacttccggacccgttaccnccgtaagtaaccgaaccgtaacccggaccgtaacgaccggtacccttacgtaaccgttttacgtttacccggtacgtaccgtaacgtacgtttaaccggaaaccgtaacccggttacgaacgggtaccgggaccggtaaaccggggaaccggtacccgggtaacccggttacggttaacccgtttacgggtttaacttttacgggggttaaccgggttacgggggttaagggttaaccgggttaaggggttttaaccggggg

SEQ ID NO: 144551 - DNA, 794 bp, Homo sapiens
  misc_feature: GYAE6OF02F5ARI.33.57.F02.1.454.CMB.1.raw
  modified_base (116)..(116): a, c, t, g, unknown or other
  misc_feature (116)..(116): n is a, c, g, or t
  modified_base (737)..(737): a, c, t, g, unknown or other
  misc_feature (737)..(737): n is a, c, g, or t
  modified_base (761)..(761): a, c, t, g, unknown or other
  misc_feature (761)..(761): n is a, c, g, or t
tcagtacacacactcacgaccggtgctcgatttagctcgatatagtgagctctgggagaagagccccagccccagaacttcccaggagtttccattcggtgatcagcactgaacanaggaggactcaccatggtagtttgggctggacgcgttcgggttttaccttgttaacgtaatttaaagtaaaaggttcgtaccgtaaggtgtcgaaggtgaccaacgtgggtggtagtcggtaggggggagtaccgtgggtacaacgtccgtggggtacgggttcccctaggacggtaccttccttaccggtgtacggcctacgccggccgtaggctttcgagtcctttcgaaggttcaacttaccgtacgtaggtcgggccgtaggacctaccggacggtacggaccgtacccgggtaaggggggaacgggtcgtagggtcgttagggtatttacgtaacgtttccgtaaggtttaagttaacgttccgttccgttacgtcccgtaacccgtaggtaaccggttcccttaaacgttaacgtaattacgtcgtaacgtaacggtacttgtaacgggttagacggtaccgtacgttaactccgtccgtcctaacgaacgtacgaacggtaccgcgaaacgtcgacctttacgaacgttgttaccgacggtacaagttacccgtaggaaacccttggacccgtaaggtcccgagggaacccggtcggtaccggtaacccggttnttcggtaacgtttagtttaccggngggttaggggtaacggtacggtagggtttacgg

SEQ ID NO: 144552 - DNA, 662 bp, Homo sapiens
  misc_feature: GYAE6OF02GCEFJ.33.57.F02.1.454.CMB.1.raw
  modified_base (267)..(267): a, c, t, g, unknown or other
  misc_feature (267)..(267): n is a, c, g, or t
  modified_base (586)..(586): a, c, t, g, unknown or other
  misc_feature (586)..(586): n is a, c, g, or t
tcagtacacacactcacgaccggtgctcgatttagctcgatatagtgagctctgggagaagagccccagccccagaaattcccaggagtttccattcggtgatcagcactgaacacagaggactcaccatggagtttgggctgagctgggttttccttgttacaattataaaggtgtccagtgtcaggtgcaacgtggtggagtcgtagggggagacctggtccaaggcctgggacggtccctgacgactctcctgtcgcacgccgntggattcagtccttacgaggtgaccttactacagttcgggctggactccggacgcggtccgtaccggaggggaacgggtctagggacgttggtactttcgaacttctaagttagttaacttcgtacttgacctacccgagtaccgtacctaacgttagaaactattccggactaagtaacttcgtaggtagaacggtacgggacgttacgtacccgtaccgtaccacccgtaagtaaccgaaccgtaaccggacccggtaaggacgtaccgtacgttaccttacgtttccgtcgacgtaagtcgtacgaacgtcgtacnggtacgacggaccgaaggtaccacggtacgttcgtattagtttacggtgggaagggttaggtaggtacggttaggg

SEQ ID NO: 144553 - DNA, 742 bp, Homo sapiens
  misc_feature: GYAE6OF02I7O1H.33.57.F02.1.454.CMB.1.raw
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (274)..(274): a, c, t, g, unknown or other
  misc_feature (274)..(274): n is a, c, g, or t
tcagtacacacactcacgaccggtgctcgatttagctcgatatagtgagctctgggagaagagccccagccccagaacttccccaggacgtttccattcggtgatcagcactgaacacagaggactcaccatggtagtttggctgagcttgggttttcctgtacattaagtaaaggtntcgagtgtcagggtnactaacgtggtgggtacgtcggtgggggataccgtggtacaacggcgtgggacggtcctagacgtacctcgtccgttgacncgtacgccgtcgtagggtcttacgagttcgttcgtacgtcgtattacccgtaaggtgtcgggtgtaggtacctccgagcggtacctcgggaaggggtaggtcgtagggtcgtaggttctcgtaagttcaacgtttaagtgttaccgtcgtttcggcccgttacccgagggtacctacccttaaagttagtaaacgtcgttaacgcttaacgtacgtcgttaggtaggtaacggtacggtaccgttaaccgtccgtacccgttaccgtaccgtaacggttacgaaccgaacggtaccggacgtacgtaccggtacttaccgttacgttaccgtacggtacgtaacgtaacggtacgtaaccgacggtacctaaccggtacggaccggtacgaaaccgggtaccgtacggtccgttacgttaccgttagttacggttgggttagggtacggtaggtaacgggttacgggg

SEQ ID NO: 144554 - DNA, 908 bp, Homo sapiens
  misc_feature: GYAE6OF02JBYJB.33.57.F02.1.454.CMB.1.raw
  modified_base (289)..(289): a, c, t, g, unknown or other
  misc_feature (289)..(289): n is a, c, g, or t
  modified_base (886)..(886): a, c, t, g, unknown or other
  misc_feature (886)..(886): n is a, c, g, or t
tcagtacacacactcacgaccggtgctcgatttagctcgatatagtgagctctgggagaagagccccagccccagaattcccaggagtttccattcggtgatcagcactagaacacagaggactcaccatggagtttggctgagcttgggttttcctgttacaattaataaaggtgtccagtgtcaggtgctaacgttggtggacgtcggtagggggactaccgtgggtacaaggtccgttaggggacggttccctaggacgtaccttctccgtggtacgcacggccgngtagtacttcagtccttcgacgtagtaccttactacgtagtcgggtcttacggactcccgacgacggtacctaccgggaaggggacgggtcgtacgggtaggtaggttacttttcctaatttcgtaacgttttaggttaacgttccgtttacgttccggtaacccgttaccgtacggtaccgttaccccttaagtttaacgtaaacttacggtacggtaactaaggttaccgttccgtagggtaccggtaagggtaacccggtaccgttaacgttaaccccggtacccggtttaccaaacccggttaaaggaaccccggttaaacccgaaccccggggtaacccgtaaaccggggttacccgtaccgtttaacccgttttaaacgttaccgggtttttacccgtaacggtaaagttaccggggtaaaaccgtttaaccgggaaaacccggtcgttaaaccccgggttagggtaccccggaaacggggtttacccccggaacgggtaacccgttacccggggtttaacgttacgtttaaaccgttttacggtttaaagggttttcggggtaaaccgggggtagggtttttaaaacggngggggttttttaaacccggggg

SEQ ID NO: 144555 - DNA, 725 bp, Homo sapiens
  misc_feature: GYAE6OF02HORU1.33.57.F02.1.454.CMB.1.raw
  modified_base (186)..(186): a, c, t, g, unknown or other
  misc_feature (186)..(186): n is a, c, g, or t
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
  modified_base (360)..(360): a, c, t, g, unknown or other
  misc_feature (360)..(360): n is a, c, g, or t
tcagtacacacactcacgaccggtgctcgatttagctcgatatagtgagctctgggagaagacgccccagcccccagaattccccaggagtttccattcggtgatcagcactgaacacagaggactcacatggagtttgggctgagcggtcgtttcggtctaaggactacgtaagtagtcagtgtnagtgacagtggtgagtcgtaggganacgtgacaacgcgtggacggctaganacgtcnctgcgcagcctgtgacttacgagtctacgagtntactacgtactaggtcgtacgaggacccttggaacgtcggactaccgaggggtacgggcgagggtaacctggttacttacggtnttaccgtattaacccggtaagttacctcggttactacggaaccccttagaacggttaccctaaaattaaacggtaaccttaaggtacccggttaacggaagtaacttcgttaggtaacgaggtaacggaccttaaccgggttaacttaaccccgtgaacccggtaacgtaaacccgaacgaacccgggattacccgtaaaggttacccaggttaacttacgtttacccgtggtttaaacaccggttaatacgtaacgacgtaaccgtacgacggtaccggaacgggtacggtaccggtaacgttaccgtaagttacggtttaagttacgggtaacggtaacgggtaggtaacgttaaggtaccgg

SEQ ID NO: 144556 - DNA, 699 bp, Homo sapiens
  misc_feature: GYAE6OF02G2XG3.33.57.F02.1.454.CMB.1.raw
  modified_base (185)..(185): a, c, t, g, unknown or other
  misc_feature (185)..(185): n is a, c, g, or t
  modified_base (285)..(285): a, c, t, g, unknown or other
  misc_feature (285)..(285): n is a, c, g, or t
  modified_base (436)..(436): a, c, t, g, unknown or other
  misc_feature (436)..(436): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattataaaaggtgtccagtgtnaggtgcaacgtgggtggagtcgtgggggagaccgtggtcaagccgtgggacgggtccctggacgactcgtcctgtgcacgccgctggacttcgagccttnaaggtcgactaactacgagtcgggctaggactccggaagacggtccgtaccgaagggggaagggtctacgggagtcggtatttcgaagtttcaagtttaacgtaacgttcgttcgttacgacctcccgaagtacggttacctaaacgttanaacgttagtcgaacgaacgtatcgtaggtaagaggacggtaccgtagttaccgtaccgttaccgtaccgaaggaaccgtaacggaacccggacgaaggacgtaccgttacgtaaccgtttaacgtttacctcggtaccgtaagtaagttaccgaaacgttaccgaccgttaggacgtaccggtaccggaaggaaccgtcggtaccgttcgttaacgttacgttaggtttcgggtaaggggtgggttacggaaggtttacgggg

SEQ ID NO: 144557 - DNA, 861 bp, Homo sapiens
  misc_feature: GYAE6OF02JOW9E.33.57.F02.1.454.CMB.1.raw
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagtacacacactcacgaccggtgctcgatttagctcgatatagtgagctctgggagaagagccccagccccagaattcccaggagtttccattcggtgatcaggcactgaacacagaggactcaccatggagtttggctgagcgtgggttttcctgttacattataaaggtgtccagtntcaggtncaacgtggtggagtcgtaggggactccgtggtctaagccgtgggacgggtcccnggagacctctccgtgtcgcaacggccgcgtggtacttacgngtccgttnacggtnacttaactactaggtcggtctacgggacgtccggaacgtacgggtcccgttacccgggaaagggggtaaccggggtccgttaggggtacggtttacggggtaacttttccggtaacgtttccttaaaggggtttaccggtttaaacgttccggggttttacgttttacccggtacccgttaaccccgggtaaacggttaccgtttaaaccccgttaaccggttttaaaggaaacccttaaggtacggaaacccgttaaggtttaaaccgttcgggttaacggtacgggtaaccgggtaccgggttaacccggttaccgtttaacccgttaaccccggttacccttaacccgtaacgggtaaccggtaaacccgttaaacccggaccggtaacgtaacccggtaccttaacccgttaaccgtttacgttaccggtaccgttaacgaacgtaagttaaccggtaaactacgtaccgtacggacgtaacggccggtaacgacggtaccgtcgttaccgtttagttacgttacggtcgggttaacgggtggttaacggtgtttacggg

SEQ ID NO: 144558 - DNA, 786 bp, Homo sapiens
  misc_feature: GYAE6OF02IGPV1.33.57.F02.1.454.CMB.1.raw
tcagtacacacactcacgaccggtgctcgatttagctcgatatagtgagctctgggagaagagccccagccccagaattcccaggagtttccattcggtgatcagcactgaacacagaggactcaccataggagtttgggctgagcgttgggtttttccttgttacaattaataaaaggtgtaccagtgtcaggtgcaactggtggagtcggtgggggataccgtggtacaagtccgtggtacgggtccctggacgtacctctcctgtcgccgagcccgcgtggattcgacgtcttacgaggtacgtaaccttaacgtactaggtcgggtcgttacggaccgttaccggaacgacgggacccttaccggggaaagggggaacggggtccgtaggggtaacggttcggtttaacgtttacgtaactttacgtaagttttaaacgttaacgttccgtttacgttcggtacccttaccccgtaagaaccgtttaccctaagtttaacgtaattacgtacgacgtaagtaacttcggtagtaggaacggcggtaccctatttcccggaacccgttcctaccggaagaccgtaaccgaccggtaccgagtaccgtacccttacgtaaccgttttcgttacagggtactaacggttaactaaccgaaacgttcccgacttaagggacccggtaacggaccggaacgggaccgttacgtaacttttaccggtaatttttacggttacggggttgggtaacgggggttacgttacgggaagggttttaccgggg

SEQ ID NO: 144559 - DNA, 186 bp, Homo sapiens
  misc_feature: GYAE6OF02G5PVK.33.57.F02.1.454.CMB.1.raw
  modified_base (172)..(186): a, c, t, g, unknown or other
  misc_feature (172)..(186): n is a, c, g, or t
tcagtacacacactcacgaccggtgctcgatttagctcgatatagttgggtttgggggaagaggaagactgacggtcccccaggagttcaggtgctgggcacagcggccctgggctgcctggtcaaggactacttccagtgtgtgtactgagcgggctggcaaggcgcatgnnnnnnnnnnnnnnn

SEQ ID NO: 144560 - DNA, 709 bp, Homo sapiens
  misc_feature: GYAE6OF02JQE52.33.57.F02.1.454.CMB.1.raw
  modified_base (334)..(334): a, c, t, g, unknown or other
  misc_feature (334)..(334): n is a, c, g, or t
  modified_base (514)..(514): a, c, t, g, unknown or other
  misc_feature (514)..(514): n is a, c, g, or t
  modified_base (564)..(564): a, c, t, g, unknown or other
  misc_feature (564)..(564): n is a, c, g, or t
  modified_base (622)..(622): a, c, t, g, unknown or other
  misc_feature (622)..(622): n is a, c, g, or t
  modified_base (654)..(654): a, c, t, g, unknown or other
  misc_feature (654)..(654): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcgttgggttttccttgttactaattaagtaaaggtcgtaccgtagtgtacgaggtgctaacgtggtaggaggttcggtgggggacgaccgtgggtaccaacggtccgtggggtacgggtccccgtaggacgtacctcttcccgtagtcgacgacggcccggtctaggtacttcgacgtccttcgacggtntaacctacgtaccgtaggtcgggtaccgtaggcgtaccggtacgacggcccgttaacggaaggggggtaacgggtcgtagggtaggttcggtacttttacgtagttacttaagttaaacggttacgttcgttagttccgtaccgtcccggtaagtccgttaccgtaagttaagacgttancgtaacgtagtatcgtaggtcggaaggtaccgaccttagcctaccgtacncggtaagaaccgtcgaaaccgcgaactacgacgttacacgtttactcgcgacgttaangttaacgactcgtctacgagacgccggtaacncgaacggtgtcgtttagtagttacgggtggtaaccgggtaggtcgtagttcgggg

SEQ ID NO: 144561 - DNA, 799 bp, Homo sapiens
  misc_feature: GYAE6OF02INAZK.33.57.F02.1.454.CMB.1.raw
tcagtacacacactcacgaccggtgctcgatttagctcgatatagtggagctcgtgggagaagacgccccacgcccagaattcccaggacgtttccattcggtgatcagcactgaacacacgaggactcaccatgggtagttgggcttgagtcgttcgggtttttacctgttaactaatttaagtaaaaggtcgttccgtaagtcggtacaggttacgacgaaccgtagggtcggtcggtccggtagggggactaccgtaggtacgaaccggtccggttaggggtaccggtaccctggtaacgtaccgttccgtaccttagggccggctaaccggcccgttacgttagggacctacgttaacgtcgttaactaccggtctacggtaccttacgcgtagtccgtaggactaccggaggtaccgcggttaccggacggggttaacggtcgtaggttacggaggtttactcggtaactcgtaaggttactaaccggttgtaccgttacgtactaccgaaggtttccgacccttaggttaactaacgtacgtacgaaccttagtaaccgtgtaggtacgtaggaccggtcttacgtacgtcgtaccgttacgacggtaacgtacaacgggtccagtacgacctacgttaaccgttagttccgtaggacttaacggaccgttaactacggaccttaccgggacgagtaacccggcgaaccgggttaccgacgttaaccgtccgtttaaacgttggtttaccggtggtttaaccgggtacggttaccgggttaggggttacccgg

SEQ ID NO: 144562 - DNA, 816 bp, Homo sapiens
  misc_feature: GYAE6OF02HENRM.33.57.F02.1.454.CMB.1.raw
  modified_base (183)..(183): a, c, t, g, unknown or other
  misc_feature (183)..(183): n is a, c, g, or t
  modified_base (303)..(303): a, c, t, g, unknown or other
  misc_feature (303)..(303): n is a, c, g, or t
  modified_base (317)..(317): a, c, t, g, unknown or other
  misc_feature (317)..(317): n is a, c, g, or t
tcagtacacacactcacgaccggtgctcgatttagctcgatatagtgagctctgggagaagagccccagccccagaattcccaggagtttccattcggtgatcagcactgaacacagagactcaccatggtagtttggctgagcgttgggtttttccttagttaacaagttaagtaaaaggtntaccagtgtcgaggtgactaagtggtggtaacgttcggtagggggacgtacccgttggacaacggtcccgtagggtaccggtccctaggacgtacctcgtccgtgtcgtacgcgcccgtntaggtacttaccgngtccttacgagttacgtaacctacgtacgtacggtcgggtctacggtaaccttccggaacgtcggtaccgtaaccgggaagggggtacgggtccgttagggacggtttaggtacttacgtagtttacgtaaagttacgttaacgttccgtttacgttaccgtcccgtaaacccgtaggttaacgttacccttaaacgttaagttaacctaagtcgtaactaagtacttcgtagtacggtagtaccgggtaccgttaccgtaccgtacccgtttaccgtaccgttaacgaaccggtaacgaacccggaccgtaaaccggacgtacccgttaaccgttaacgtttacgttccgtaagtaaccgtacgttaacgtaaccgtaaccgtacgtaccgtaagggaccgtaccggaaccggaacgggtacccgtacggtacgttacgtttaacgtttaggtttccgtaaggggttacggtaagggttaggttaacgggtttacggg

SEQ ID NO: 144563 - DNA, 634 bp, Homo sapiens
  misc_feature: GYAE6OF02H4QZU.33.57.F02.1.454.CMB.1.raw
  modified_base (215)..(215): a, c, t, g, unknown or other
  misc_feature (215)..(215): n is a, c, g, or t
  modified_base (454)..(454): a, c, t, g, unknown or other
  misc_feature (454)..(454): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
  modified_base (583)..(583): a, c, t, g, unknown or other
  misc_feature (583)..(583): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagcttgggttttccttgttacaattataaaaggtgtcagtgtcaggtgcaactggtaggagtcgtgggggganaccgtggtacaagccgtgggacgggtccctgacgactctctagtgacaggccgcgtaggactttcgacgtccttacgagtcgaacttaaccgtacaggttggggcttacgggattacccggacgaggccttaaccggagggggaacgggcgttgggaggttggtacttttcgtaagttctaattaggttaacttcggttctttacgacccagtacgttaccctagtttaagaattacgngaactagtaacttcgtaggtagaggtacgtacctatccacgtctacgagaacgcgtacgcgaagtcacctanactttntctgactagtactagaacagcctagagtacccgagacggttacgacggttntagtttacaagtttgacgggttagggaacggttgtacggttggtttaacgg

SEQ ID NO: 144564 - DNA, 874 bp, Homo sapiens
  misc_feature: GYAE6OF02H8U80.33.57.F02.1.454.CMB.1.raw
  modified_base (264)..(264): a, c, t, g, unknown or other
  misc_feature (264)..(264): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggagtttgggctgagctgggttttccttgttacaattaataaaaggtgtaccagtgtcaggtgcaacgtgggtggagtcggtgggggacgaccgtgggtacaagccgtgggacgggtccctgacgactctctgtncagccgcgtggtatcgagtcttcgagtacgtactactacgaggttcggggtactcgggacgtcccggacgtacggcctaccgggaaggggggtaacggggtcgttagggggaacggttcgggttaactttttacgtaacggtttaacctaaagttttaaacggttaaaccgttttccgggtttacgttaccggtacccgtaacccccggtaaggtaacccggtttacccctaaaacgttttaaacggtaactttacggtaacggtaacccgttaaaggttaacgttacggtttagggtaacgggtaaacggtaacccgggggttaccccttaattacccccggtaaccccgggttactacccgggaaaaccgggtaaccgaacccgtaaccgggacccggtaaggtaaccgtacccttaccgttaaccgtttaacgttttcccgacggtaaacgaagttaacgtacggtaaaccgccggttaacgaacggaccggaaccgggtacccgggtaacgacccggttaaccgggtcccttttagttaaccgtttagtttaccggggttaggggttaacgggggtacgggtttaacggggtaggttttacggggg

SEQ ID NO: 144565 - DNA, 693 bp, Homo sapiens
  misc_feature: GYAE6OF02JC2EP.33.57.F02.1.454.CMB.1.raw
  modified_base (404)..(404): a, c, t, g, unknown or other
  misc_feature (404)..(404): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (500)..(500): a, c, t, g, unknown or other
  misc_feature (500)..(500): n is a, c, g, or t
tcagtacacacactcacgaccggtgctcgatttagctcgatatagtgagctctgggagaagagccccagccccagaattcccaggagtttccattcggtgatcagcactgaacacagaggactcaccatggtagttgggctgagtcgttgggtttttcccttgttactaattaataaaaggtcgtaccagtcgtcgtaggtgacgaacgttgggtggagttcggtaggggacgtacctgggtacaacgtccgtgggacgggttcccctggacggtccttccgtcctggttcgacgacgccgacgtggtattcgactcttacgagtagaccttacacgtagtgggtactggacgttccgacgtagcctcggaaggggtacgggtcgtaggaggttcggtacgttntacgttactagttaacgtatccggttctcgactcccgaaggttcgtacctaagttnaagtntcgtacgataagtcttgagggacgacgtaccggtntaccgttaccgctaacgagaaccgtaccgaaccgcgagtactccgttactacgtttacttcgacgtttcaacggtctaaccggtacgtaaccgtccggaggaccgtcggacccgggttaacgaccgtagggtaccttcgtaagtttaccggttggttaccgggtagggtaacgggttcttaaaggtttcgggg

SEQ ID NO: 144566 - DNA, 256 bp, Homo sapiens
  misc_feature: GYAE6OF01BYYZ0.37.87.H10.1.454.CMB.1.raw
  modified_base (256)..(256): a, c, t, g, unknown or other
  misc_feature (256)..(256): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaatctacactactgagcgggctggcaaggcgcatagn

SEQ ID NO: 144567 - DNA, 254 bp, Homo sapiens
  misc_feature: GYAE6OF01C13MJ.37.87.H10.1.454.CMB.1.raw
  modified_base (253)..(254): a, c, t, g, unknown or other
  misc_feature (253)..(254): n is a, c, g, or t
tcagtagtgtagatcacgaccggtgctcgatttagcagtactgcgttgggtttgggacagatttcactctcaccatcagcggcctccagtctgaagatgttgcaacttattactgtcaacagtatcaggatgtcccgtggacgttcggcccagggaccaaggtggaaatcagacgaactgtggctgcaccatctgtcttcatcttcccgccatctgaatctacactactgagcgggctggcaaggcgcatagnn

SEQ ID NO: 144568 - DNA, 546 bp, Homo sapiens
  misc_feature: GYAE6OF01D6TGT.37.87.H10.1.454.CMB.1.raw
  modified_base (524)..(524): a, c, t, g, unknown or other
  misc_feature (524)..(524): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccaacgggcccatccggtcttccccctggccaccctcctccaacgacgccaccctcgtcgggggcacgacgccggcccgtcgggcctcgcctcggtcaaggactaccttccatctacactacngagcgggctggcaaggcgcgag

SEQ ID NO: 144569 - DNA, 256 bp, Homo sapiens; identical to SEQ ID NO: 144566
  misc_feature: GYAE6OF01BWXTF.37.87.H10.1.454.CMB.1.raw
  modified_base (256)..(256): a, c, t, g, unknown or other
  misc_feature (256)..(256): n is a, c, g, or t

SEQ ID NO: 144570 - DNA, 269 bp, Homo sapiens
  misc_feature: GYAE6OF01CM16Y.37.87.H10.1.454.CMB.1.raw
  modified_base (261)..(269): a, c, t, g, unknown or other
  misc_feature (261)..(269): n is a, c, g, or t
tcagtagtgtagatcacgaccggtgctcgatttagcagtactgcggtttgggtttgggacagatttcactctcaccatcagcggcctccagtctgaagattttgcactttatttcctgtcaacactatggtgactggcctccgtacacttttggccagggggaccaaactggagatcaaacgaactgtggctgcaccatctgtcttcatcttcccgccaatctgaatctacactactgagcgggctggcaaggcgcatagnnnnnnnnn

SEQ ID NO: 144571 - DNA, 537 bp, Homo sapiens
  misc_feature: GYAE6OF01DXN6U.37.87.H10.1.454.CMB.1.raw
  modified_base (535)..(535): a, c, t, g, unknown or other
  misc_feature (535)..(535): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactgggccagggaaccctggtcaccgtctcctcagcctccaccaacgggcccactcggtcttccccctggccaccctcctccaacgacgccaccctcgtcggggcacgacgccggccctgggctcgcctggtcaaggactacttccatctacactctgagcggctggcaaggcgnag

SEQ ID NO: 144572 - DNA, 258 bp, Homo sapiens
  misc_feature: GYAE6OF01EZK7F.37.87.H10.1.454.CMB.1.raw
  modified_base (256)..(258): a, c, t, g, unknown or other
  misc_feature (256)..(258): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaatctacactactgagcgggctggcaaggcgcatagnnn

SEQ ID NO: 144573 - DNA, 629 bp, Homo sapiens
  misc_feature: GYAE6OF01C2FV5.37.87.H10.1.454.CMB.1.raw
  modified_base (321)..(321): a, c, t, g, unknown or other
  misc_feature (321)..(321): n is a, c, g, or t
  modified_base (587)..(587): a, c, t, g, unknown or other
  misc_feature (587)..(587): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccgagggaaggggctgggagtgggtctcaggtattactggtagtggtaataccgcatactacgcagactccgtggacgggccggttcaccgtctccagagacaattccaagaatacggtctatctggaaatgaacagcctgagagccgaggacacggccctctattacngtgcgagagatcgaagacggatagtagcagcagctctgactacgcgggacccaacggtaacccctggtccacccgtcctccctcgacgccctcccaaccgaaccgggccccacgttcccggttcccttcccccgtcggcccctacccctccctaccgaaacgcgaccctacccgtccggtcggggaccacgacggcccggcccgtgggcctcggccgtggtaccgaacggtaccttaccttccacttaccgtacctaacgtaccgnggacgggccgggtcgtacggaccggaaacggccgacgtaacg

SEQ ID NO: 144574 - DNA, 547 bp, Homo sapiens
  misc_feature: GYAE6OF01B6PUI.37.87.H10.1.454.CMB.1.raw
  modified_base (545)..(545): a, c, t, g, unknown or other
  misc_feature (545)..(545): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggccctctattactgtgcgagagatcagacggagtatagcagcagctctgactacgtggggccacggaaccctggtccaccgtctcctcagcctccaccaacgggcccacgtccgtccttccccctcggccacccctcctaccaacgacgccacctcgtcggggcacgacgccggcccgtcgggctcgcctggtcaacggactactccactctacactactgagcggctggacaacggcgnag

SEQ ID NO: 144575 - DNA, 531 bp, Homo sapiens
  misc_feature: GYAE6OF01EIBJS.37.87.H10.1.454.CMB.1.raw
  modified_base (387)..(387): a, c, t, g, unknown or other
  misc_feature (387)..(387): n is a, c, g, or t
  modified_base (529)..(529): a, c, t, g, unknown or other
  misc_feature (529)..(529): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtcncctcacgcctccaccaagggcccatccggtcttccccctggccaccctcctccaacgacgcacctctggggcacagccggccctgggcctcgcctggtccaaggactcttccatctacactctgagcgggctggcaaggcgnga

SEQ ID NO: 144576 - DNA, 541 bp, Homo sapiens
  misc_feature: GYAE6OF01DE21X.37.87.H10.1.454.CMB.1.raw
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgacgactggggccagggaaccctggtcaccgtctcctcacgcctccaccgaacgggccccatccggtccttccccctggccgcccctgcctccgaggacgccaccctccgagacgcacacgccggccctgggctgcctggtacaggactaccgtccatctacactacngacgcgggntcggcaggccg

SEQ ID NO: 144577 - DNA, 581 bp, Homo sapiens
  misc_feature: GYAE6OF01CN6NY.37.87.H10.1.454.CMB.1.raw
  modified_base (545)..(545): a, c, t, g, unknown or other
  misc_feature (545)..(545): n is a, c, g, or t
tcagtagtgtagatcacgaccggtgctcgatttagcagtactgcgttgggtctgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacgggaacccctggtccaccgttctccctcacgccctaccacccgaacgggcccagttccggtccttccccccgtggcccacccctccctcccaagacgccacctccgtcgggggccacgacggccgggcccgtgggctcggccgtggtaccaaggccttacttccgattcctaacnccttacgtggacgccggggctgggacaaggtcgacg

SEQ ID NO: 144578 - DNA, 258 bp, Homo sapiens
  misc_feature: GYAE6OF01E32M6.37.87.H10.1.454.CMB.1.raw
  modified_base (250)..(250): a, c, t, g, unknown or other
  misc_feature (250)..(250): n is a, c, g, or t
  modified_base (256)..(258): a, c, t, g, unknown or other
  misc_feature (256)..(258): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaatctacactactgagcgggctggcaaggcncatagnnn

SEQ ID NO: 144579 - DNA, 259 bp, Homo sapiens
  misc_feature: GYAE6OF01DKB5N.37.87.H10.1.454.CMB.1.raw
  modified_base (256)..(259): a, c, t, g, unknown or other
  misc_feature (256)..(259): n is a, c, g, or t
tcagtagtgtagatcacgaccggtgctcgatttagcagtactgcgttgggtttgggacagattcactctcaccatcagcggcctccagtctgaagattttgcactttatttctgtcaacactatggtgactggcctccgtactacttttggccaggggaccaaactggagatcaaacgaactgtggctgcaccatctgtcttcatcttcccgccatctgaatctacactactgagcgggctggcaaggcgcatagnnnn

SEQ ID NO: 144580 - DNA, 608 bp, Homo sapiens
  misc_feature: GYAE6OF01AJY28.37.87.H10.1.454.CMB.1.raw
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccgagggaagggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattacngtgcgaganatcagacggatatagcagcagctctgactacgtggggacccacggaaccctggtaccacccgtctccctcacgcctcccaccgacggcccacgtccgtcccttccccgcggtacccaccccgtccctacccgaacgacgacctacccgtcggtacggggccaccgacggcccggaccgtcgggcctcgtccgtaggtaccgaacggaccttacctacccacgtcctaaccacgttacgtacggaccggccgggtacgtcgggaccgacgggccgcgtacg

SEQ ID NO: 144581 - DNA, 631 bp, Homo sapiens
  misc_feature: GYAE6OF01C41YD.37.87.H10.1.454.CMB.1.raw
tcagtagtgtagatcacgaccggtgctcgatttagcagtactgcgttgggtctgggggaggcttggtacagcctggggggtccctgagactctcctgtgcagcctctggtttcaactttggtagctattggatggactgggtccgccagtctccagggaaggggctggagtgggtggccaacatacagggaggtggtggtaacgaaaaactatgtggactctgtgcgggccgattcaccatctccagagacaacgaccaaaaactcactgtatctgacaaagtggacggcctagagactccgaggacacggctgtgtattattgtgacgagagtatttaagaactaactaaagtttcgagtgaactggtatgtagtgtcttatgaacgtaccgtcggggtaccgaacgggaacctacgtacggtccgtacccgttacgtccttacctacgccctacccctaacccggaaccgggacccgtaccgttccggtcccgttccccccgttcggccggtcccctcgccgtaccgacggacgaccgacccgtccgacgacgcaccgcgaccggcccgtcggctcggccgtcggtagacggtactaccttccactacctactactacgtgcggccggg

SEQ ID NO: 144582 - DNA, 757 bp, Homo sapiens
  misc_feature: GYAE6OF01B5RCJ.37.87.H10.1.454.CMB.1.raw
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
tcagtagtgtagatcacgaccggtgctcgatttagcagtactgcgttgggtttgggggaggcttggtactagcctggggggtccctgtaggtacgtctcctagtacgcagtccttcgttcggttttcattcttttaaacgctaaactacgccaatgacgccttgggtcccgccagggcctccgaagggaaggggctggacgttgggttcttcgaggtattacgtggtagtggtaataccgcactactacgcgagacctcgtgacgggtccgttcaccgtctccgagagactaataccaagactacggtctatctaggaaatgaacngcctagagtagccgagtaccaccggtccctctattactgtgcgagngactcgaggacgagtatacgcagcgagtctgtggactacggtcgggaaccctaacggtaaccttgggtaccctaccgtcctaccgtcgtaccgtacccgttacccgaacccgtaaccgggacccccgtaacgttccccggttaccctttaccccccgacggtacccctacccccgttaccctaacccgtaaccgaccgtacctaacccgtacggtccggggacccacggaccggtacccggtcccgttgggaccttccggtacccgttaggtacccgtaacggttacctaacccgttacccgtaaccgttcccgttaaccgttaccgttcgttacggacggtccgggtccggtacgggaaccggtaaccgggaccgcggtaacgg

SEQ ID NO: 144583 - DNA, 601 bp, Homo sapiens
  misc_feature: GYAE6OF01CCP3G.37.87.H10.1.454.CMB.1.raw
tcagtagtgtagatcacgaccggtgctcgatttagcagtactgcgttgggtctgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagatacggtctatctggaaatgaacagcctgagagccgaggacacggccctctattactgtgcgagagatcagacggagtatagcagcagctcgtgactacgtggggaccaccggaaccctggtacctacccgtctccctcacgccctcccaccgaacggcccacgtccggtcccttcccccgtcggcccgcccctgccctccgacggacgccgaccctccgacggcgccacgacggccggcccgtcgggcctcggccgtcgggtacgaacggtaccgttaccttcccacttcctacctaccgttaccgtacggacggtccgggcgttgggacggtaacggg

SEQ ID NO: 144584 - DNA, 634 bp, Homo sapiens
  misc_feature: GYAE6OF01A4Z7H.37.87.H10.1.454.CMB.1.raw
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgccctcccaccgaacgggccccacgtccggtccttcccccgtcggcccacccctccctcccaacgacgccacccgtcgtcgggggcaccgaccgccggcccgtcgggcctcggccgttcgggtaccgaacgggtaccttacccgttacccgtaccttccgttaaccctaaccgttaccgtacgggaaccgggtccgggggtaccttacggggacccgaaacggggcccggtccgtaacg

SEQ ID NO: 144585 - DNA, 655 bp, Homo sapiens
  misc_feature: GYAE6OF01CMV27.37.87.H10.1.454.CMB.1.raw
  modified_base (332)..(332): a, c, t, g, unknown or other
  misc_feature (332)..(332): n is a, c, g, or t
tcagtagtgtagatcacgaccggtgctcgatttagcagtactgcgttgggtttgggggaggcttggtacagcctggggggtccctgagactctcctgtgcagcctctggattcaactttggtagctattggatggactgggtccgccagtctccagggaaggggctggagtgggtggccaacatacagggaggtggtggtaacgaaaaaactatgtggactctgtggcggggccgattcaccatctccagagacaacgaccaaaaactcactgtatctgacaaatggaccggcctgagactccggaggaccacggctgtgttattattgtgngagagtatttagaactaataaagtttcgagtgactggtatgtatgtactttatgactaccgtggggaccaaaggggacctagtcggtaccaccgttcttcttccacgtccctacccgaacccgaacgggcccctacgttcccggttcccctttccccccgtcgggccccgtccccttcgccctacccgaacgggaccgacccaccccgtccggaagaccgaccaccgacggcccggcccgtcgggcctcggtcccgtagggtaccaacggtacccttaccgttacccacgttacctaaccgtaccttacgtggacggtccggg

SEQ ID NO: 144586 - DNA, 259 bp, Homo sapiens
  misc_feature: GYAE6OF01DI948.37.87.H10.1.454.CMB.1.raw
  modified_base (257)..(259): a, c, t, g, unknown or other
  misc_feature (257)..(259): n is a, c, g, or t
tcagtagtgtagatcacgaccggtgctcgatttagcagtactgcgttgggtttgggacagatttcactctcaccatcagcggcctccagtctgaagattttgcacttttatttctgtcaacactatggttactggcctccgtacacttttggtccaggggaccaaactggagatcaaacgaactgtggctgcaccatctgtcttcatcttcccgccatctgaatctacactactgagcggctggcaaggcgcatagnnn

SEQ ID NO: 144587 - DNA, 262 bp, Homo sapiens
  misc_feature: GYAE6OF01BYISB.37.87.H10.1.454.CMB.1.raw
  modified_base (259)..(262): a, c, t, g, unknown or other
  misc_feature (259)..(262): n is a, c, g, or t
tcagtagtgtagatcacgaccggtgctcgatttagcagtactgcgttgggtttgggacagatttcactctcaccatcagcggcctccagtctgaagtattttgctactttatttctgtcaacactatggtgactggcctccgtactactttggccaggggaccaaacgtggagatacaaacgaactgtggctgcaccatctgtcttcatctccgccatctgaatctacactactgagcgggctggcaaggcgacatagnnnn

SEQ ID NO: 144588 - DNA, 580 bp, Homo sapiens
  misc_feature: GYAE6OF01AL00A.37.87.H10.1.454.CMB.1.raw
  modified_base (320)..(320): a, c, t, g, unknown or other
  misc_feature (320)..(320): n is a, c, g, or t
tcagtagtgtagatcacgaccggtgctcgatttagcagtactgcggttagggtctgggggaggcttggtacagtccctcggggggtccctgagactctcctgtgcaggcctcgtggtttacatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggccctntattactgtgcgagagatcagacggagtatagcagcagctctgactacgtggggccacggaaccctggtccaccgtctcctcacgcctaccaccgaacgggcccacgtccggtccttccccctggcccacccctcctccgaagacgccacctccgtcggggccacgacggccggcccgtgggcctcgccgtcggtacacggaccttacctccgactacctacacttaccgtgacggcgggacgtcggacgaacggcgacg

SEQ ID NO: 144589 - DNA, 587 bp, Homo sapiens
  misc_feature: GYAE6OF01CLGLK.37.87.H10.1.454.CMB.1.raw
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacggccgttcatcgtctccagagacaattccaaagatacggtctatctaggaaatgaaacngcctgagagccgaggacacggcctntattactgtgcgagagatcagacgagtatagcagcagctcgtagactacgtcgggaccaacggaccctggtccaccgtctcctacacgccctaccaaccgaacgggcccacgttccggtccttcccccgtggccctacccctccctaccaacgaccgccacctcggtcggggaccacgacggccggcccgtgggcctcggccgtcggtaccgaacggtacctaccgttcctagtcctaactacctacgtgacggcgggtcagggacacggccgtacg

SEQ ID NO: 144590 - DNA, 628 bp, Homo sapiens
  misc_feature: GYAE6OF01B4E0D.37.87.H10.1.454.CMB.1.raw
  modified_base (206)..(206): a, c, t, g, unknown or other
  misc_feature (206)..(206): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgnatactacgcagactccgtgacgggcgttcaccgtctcagagacaattccaagaatacggtctatctaggaaatgaaacagcctgagagccgaggacacggcctctattactgtgacgagagatcagacggagtanagcagcagctcgtgactacgnggggccaacggaaccctggtccaccgttcctacctcacgcctcccgaaccgaacgggccctagtcccggttacccttcccccgtcggccctacccctacctacccgaaagacgtaccgaacccgtcggtcgggggacaaccgacggcccggacccgtgggcccgtagtcccgtcgggtacctaaacgggtaccttaccgttaccacgttccctaaccacgttaacctggaacggccgggtccgtacggacgaaacggcgacgtaag

SEQ ID NO: 144591 - DNA, 258 bp, Homo sapiens; identical to SEQ ID NO: 144572
  misc_feature: GYAE6OF01DYVX1.37.87.H10.1.454.CMB.1.raw
  modified_base (256)..(258): a, c, t, g, unknown or other
  misc_feature (256)..(258): n is a, c, g, or t

SEQ ID NO: 144592 - DNA, 693 bp, Homo sapiens
  misc_feature: GYAE6OF01CRUQO.37.87.H10.1.454.CMB.1.raw
  modified_base (144)..(144): a, c, t, g, unknown or other
  misc_feature (144)..(144): n is a, c, g, or t
  modified_base (207)..(207): a, c, t, g, unknown or other
  misc_feature (207)..(207): n is a, c, g, or t
  modified_base (308)..(308): a, c, t, g, unknown or other
  misc_feature (308)..(308): n is a, c, g, or t
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgcatgagctgggtccnccaggctcgagggagggctggagtgggtctcgaggttattacgtggtagtaggtaactaccgnaatactacgcagactccgtgacgggtccggttcaccgtctcagacgactattccaagaatcggtactatcgtagaaatgaacagcctgagacgcgaggacncggcctatattactgtcgcgagagatacagacggatgagcagctagctcgtagactacggtcgggaccaaccggtaccgtgtaccaccgttcnccctacncgtccctaccgaccgaccggaccctacgtacccggttcccgttaccccgtccggaccctacccctcccgtaccgtaacggaccgcccgtacccgtccgggtcgggacccgtaaccggaccggccccgggtaccggtccgggtccgtaccggtcccggttacgggtaccgtaaaccgggttaccttacccgtttccctaaccgttacccgttaaccgtacccgttacggtaccgggacgggtccggggtacccgtacggggacccgaaacgggccgtacggtaacg

SEQ ID NO: 144593 - DNA, 576 bp, Homo sapiens
  misc_feature: GYAE6OF01AR90R.37.87.H10.1.454.CMB.1.raw
  modified_base (572)..(572): a, c, t, g, unknown or other
  misc_feature (572)..(572): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaaattccaaagaatacggtctatctggaaatgaacagcctgagagccgaggacacggccctctattactgtgcgagagatcagacggagtatagcagcagcctctgactacgtcggggcccacggaaccctggtaccaccgtctcctcacgccctccaccgaacgggcccacgtccggtccttccccgtcggacccacccctccctaccaacgacgccacctcgtcggggcacgacggccggcccgtggcctcgccgtggtacaacggaccttacctcctactcctaacacgtacgtgacggcggtcgtggacgaggccgntacg

SEQ ID NO: 144594 - DNA, 692 bp, Homo sapiens
  misc_feature: GYAE6OF01DYCGF.37.87.H10.1.454.CMB.1.raw
  modified_base (147)..(147): a, c, t, g, unknown or other
  misc_feature (147)..(147): n is a, c, g, or t
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (300)..(300): a, c, t, g, unknown or other
  misc_feature (300)..(300): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
tcagtagtgtagatcacgaccggtgctcgatttagcagtactgcgttgggtttgggggaggcttggtacagccgtggggggtccctgagactctcctgtgcagcctctggtttcattctttagcaactacgccatgagctgggtccncaggctccgagggagggctggagtggtctcgaggttattacgnggtagtagtaactaccgntatactacgcagactccgtgacgggtccgttcaccgtctcagagacaatccaagatcgtctatcgtagaaatgaacngctgagcgcgagacncgccctatatactgcgacgagagancgaggtacgatanagcagacngctgtacgacgtacgtcggggaccctaacggacccgttgaccccgtaccgtctacccgacgaccgtcccgtaccgaacccgtaccgggccctaccggttcccggtcccctttaccccgcggtacccctaaccccttcgaacccgtaacgaccgtacccgtacccgtcgggtaccgggacctaccggaccgggccccggtcccggtcggtcccgtcggacccggttaggtaacccgtaaaccggttacccttaaccgttacccgtaccgttacccgtactttaacccgtaaaccgaccgttaacggtcgggacggttcccgggacggtaccggtacgaacgggtccg

SEQ ID NO: 144595 - DNA, 296 bp, Homo sapiens
  misc_feature: GYAE6OF01EK0KR.37.87.H10.1.454.CMB.1.raw
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctggaaatgaacagcctgagagccgg

SEQ ID NO: 144596 - DNA, 262 bp, Homo sapiens
  misc_feature: GYAE6OF01EQCCV.37.87.H10.1.454.CMB.1.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (259)..(262): a, c, t, g, unknown or other
  misc_feature (259)..(262): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatgttgactggcctccgtacacttttggccaggggaccaaactggagatacaaacgaactgtggctgcaccatctgtcttcattccttcccgcatctagaactctacactactgagcggntggcaaggcncatagnnnn

SEQ ID NO: 144597 - DNA, 687 bp, Homo sapiens
  misc_feature: GYAE6OF01EAQMR.37.87.H10.1.454.CMB.1.raw
tcagtagtgtagatcacgaccggtgctcgatttagcagtactgcgttgggtctgggggaggcttggtacagcctgggggggtccctgagactctcctgtgcagcctctggattcaacttttggtagctattggatgggactgggtccgccagtctccgaggggaagggctggagtggggtgaccaacatacgaggggaggtggtagggtaacgaaaaacgtgtggtggaccttcgtggtggccgggggccgtattccaaccatcctaccagacgaccaacgaccaaaaactcactgtactctgacaaagtcggacgcctgagatccggagacgacggctgtagttattagtgtgacgagtagtattaagactaactaaggttcagtgacgtggtatgatgtacttatgtactacggcggggacaaggacctagtcggtaccaccgtctccgtacgacgtacccctaccgaaccggacggaccccgtacgttcccggttcccttcccccggtcggcccgtcccgtcgccgtaccgacgggaccgtcccaccgtaccggaacgaccgtacccgacggtaccgacccgggtcccggtcggtccgtcccgtacggttaccgggaacgttaaccggacccttaacctttacccgtaagttaccccaattaacccgtggttcggtaacccggg

SEQ ID NO: 144598 - DNA, 271 bp, Homo sapiens
  misc_feature: GYAE6OF01EUD9F.37.87.H10.1.454.CMB.1.raw
  modified_base (266)..(271): a, c, t, g, unknown or other
  misc_feature (266)..(271): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtactacttttggccaggggaccaaactggagatcaaacgaactgtggctgcaccatctgtcttcatccttcccgcctatctagaatcctaacactactgacggcgggctcggcaaggcgcaatagnnnnnn

SEQ ID NO: 144599 - DNA, 721 bp, Homo sapiens
  misc_feature: GYAE6OF01DI6BB.37.87.H10.1.454.CMB.1.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
tcagtagtgtagatcacgaccggtgctcgatttagcagtactgcgttgggtttgggggaggcttggtacagccgtggggggtccctgagactctcctgtgcagcctctggtttcattctttagcaactacgccatgagctgggtccgccaggctcgaggggaaggggctgggagtgggtctcgaggtattacgtggtagtggtaaactaccgnatactacgcagctccggnggacgggtccggttcaccgtcnccagacgacaattccaaagaactcggtctatctaggaaaatgaacagcctagagacgccgaggaccacggccctctaacttacgtggtcgacggaaggagtacgtaccgaaggaacgggtaagtactaagcgagcaaggtccttcgtacgtaaccgtaccggtcgggggacccaaccggggtaacccctgggttccccaacccggttcctacccgtacaccgtccctacccgaacccggaaccgggacccctacgttcccggttccccgttaccccgtcggcccaccccgtccctaccgaacgacgcctaccgtcggtcggggcacgacggcccggtccggtcgggccgtcgccggttcggtaccgtaacgggtaaccttaccgttacctaacgttacctaaccgtaccgttaacgtacgggacggccgggtaccggtacggtaccgggaaacgggccgtcgtaacgg

SEQ ID NO: 144600 - DNA, 263 bp, Homo sapiens
  misc_feature: GYAE6OF01A6IV8.37.87.H10.1.454.CMB.1.raw
  modified_base (259)..(263): a, c, t, g, unknown or other
  misc_feature (259)..(263): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtacacttttggccagggggaccaaaactggagatacaaacgaactgtggctgcaccatctgtcttcatcttcccgcatctgaatctacactactgacgcggctggcaaggcgcaatagnnnnn

SEQ ID NO: 144601 - DNA, 822 bp, Homo sapiens
  misc_feature: GYAE6OF01CSUBA.37.87.H10.1.454.CMB.1.raw
  modified_base (146)..(146): a, c, t, g, unknown or other
  misc_feature (146)..(146): n is a, c, g, or t
  modified_base (215)..(215): a, c, t, g, unknown or other
  misc_feature (215)..(215): n is a, c, g, or t
tcagtagtgtagatcacgaccggtgctcgatttagcagtactgcgttgggtctgggggaggcttggtacagcctgggggggtccctgagactctcctgtgcagcctctggtttcatctttagcaactacgccatgagctgggtccnccaggctccgaggggaagggctgggagtgggtctcgaggttattacgtggtagtaggtaaactacccgnattactacgcaagacctccggtgaccggggtccgttcaccgtctccgaagacgaactaacttccaaaggtaacttacgggtcttaattcgtaggtaaaaatggaaaccacggcccttaggaaggaaccggcccggaagggtaacccaccggtccccttacttaattaccgtggtgaccggtaaggacgaagttacgaaacgggaacgggtagtaaacgtggaccacgggtcaacgtcctttacgtacggtaaccttacgggtccgggggaacccctaaacccggggtaaccccgtttgggtaccccgtaacccggttccttacccgtaccgaccgtacccctaccccgaacccggtaaccgggcccctaacgttcccggttaccccttcccccggtacggacccctacccccgtaccctaccgaaacgaccgtacccgtaccgtcgggtccggggaccaccggaccggcccgggtcccgtcgggtccgttccggccggtacggtaccgaaacgggttacccttaccgttacccgtaacgttacctaaccgtaccgttaaccgtcgggacggtacccgggtacgtacgggaaccgtagggcccgtaag

SEQ ID NO: 144602 - DNA, 720 bp, Homo sapiens
  misc_feature: GYAE6OF01BPU36.37.87.H10.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (312)..(312): a, c, t, g, unknown or other
  misc_feature (312)..(312): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgnatactacgnagactccgtgacgggccgttcaccgtcnccaganacaattaccaagaatcggtntatctaggaaatgaacngcctgagagccgaggacacggccctntattacgtgtgacggagagatacgaaggacggaagtaataggactacgcgtaacgtcttcgtagtaaccgttacggtccgggggaccctaaccgggtaaccccttgggtaccctaaccccggtccttcccgtacgaccgtcccctacccggaacccgtaacggggccccctaacggtttccccggtaccccttaccccccggtggtacccctacccccgttacctaccgaaacggaccgtacccgacccggttcgggtacgggaccaaccgacgggtccccggtcccgtacggggtccttccgggaccgttacggtaccgaacggttacttacccgttaccgtacttcccgtaaacctaccgttaccgtaggaccggccgggtctacggacgaacggcgaacgtaagg

SEQ ID NO: 144603 - DNA, 631 bp, Homo sapiens
  misc_feature: GYAE6OF01ACSIU.37.87.H10.1.454.CMB.1.raw
tcagtagtgtagatcacgaccggtgctcgatttagcagtactgcgttgggtctgggggaggcttggtacagcctgggggggtccctgagactctcctgtgcagcctctggtttcatcttttagcaactacgccatgagctgggtccgccaggctccagggaaggggctggagtgggtctcaggtattactggtagtggtaataccgcatactacgcagactccgtggaccgggtccgttcaccgtctccagacgacaattccaagaatacggtctatctggaaatgaacagcctagagagcgaggcacgccctctatactgtgcgagagactcaagacggagtatagcgagcagcctcgtgtactacgcggggaccacggtacccgtcggtacctccgtctcctcgacgcctaccaccgacggccctacgtccgttcccttcccctcggacccctcccctccctaccgaacgccgcccgtaccgtccgtaccggggcctaaccgaccggtcccggtccccggtcgggtccgtcggtccgtcggtaccgaccggtaccttaccttacccgtacttacccgtacctacgttaccgtacgggacggccgggtacgtcggacgtaggccgtaacg

SEQ ID NO: 144604 - DNA, 678 bp, Homo sapiens
  misc_feature: GYAE6OF01A2IHC.37.87.H10.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagtagtgtagatcacgaccggtgctcgatttagcagtactgcgttgggtctgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgnatactacgcagactccgtgacgggtccgttcaccgtntaccagagacaattccaaagaactacggtctatctaggaaatgaacagcctgagagccgaggacacggccctatattactgtagcgagagatcagacgatatagcagcagctagcgactacgtgggcaacggaccctggtccaaccgtctaccacacgcctaccgaaccaacgggacccacgttccggtacccttcccccgtacggaccctaccccgtcctacccgaagtaccgaccgtaacccgtcggtacggggtaccaacgaccggcccgggtacccggtcgggtacccgtcgggtacccgttacgggttaccgtaaacgggtacccgttaacccgtttaccccgtaaacgttacccttaaccgtaaacccgttaccgttacgggaccggtacccggggacgtaccgggtaaccgaaacgggtccggtaacccg

SEQ ID NO: 144605 - DNA, 881 bp, Homo sapiens
  misc_feature: GYAE6OF01BY78G.37.87.H10.1.454.CMB.1.raw
  modified_base (457)..(457): a, c, t, g, unknown or other
  misc_feature (457)..(457): n is a, c, g, or t
tcagtagtgtagatcacgaccggtgctcgatttagcagtactgcgttgggtcgtgggggaggcttggtacagccgtgggggggtccctgagactctcctgtgcagcctcttggtttcattctttagacaactacgccatggagcgttcgggtccgccgagggcctccgaaggggaaggggctagggaggtcgggtctcgtaaggttatttacgtagggttacggttaggttaaaactacccggactaacttaaccgttacggacaacggtaccgttccggttagggaacccggggtccggttttaccacccggttcaccgaaggtaacgtaactaaacttaccgaaaaggtaacgttaccgggttattaacgtacgttaaggaaaacgtacgaacgacggccgtaggaacggacggaccggtaacggaccgacccggtcctttagttacgtttacgngtacgcgtaagaagtctacggaaaggtacggtaagtaatacgcgacgtacgtacgtctacgttacgaccggtacgggttacgggaccgaaccggtacccgttccggtaacccttcgtacccttccgacgaccgtcccgaacccgaaccggtaccggtacccgttaccgtcccgtttcccgttaccccgtaccggaccccttaccctcccgtaaccgaaccgtccgtacccgtaccggttcgggccggggtacctaaccgggaccgggtcccggtacccgggtccgggtccgttacccggtaccggttacggtaaacggtaaacccggtttcctaaacccgtttacccgaccgtttaccgtaaaccgttacgtaccggtacgggacgggtaccgggtacggccgggtaacggccggtcgtaaacg

SEQ ID NO: 144606 - DNA, 727 bp, Homo sapiens
  misc_feature: GYAE6OF01CWD3F.37.87.H10.1.454.CMB.1.raw
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgcaggctccagggaaggggctgggagtgggtctcaggtattacgtggtagtggtaataccgcatactacgcagacctccgtggaccggggccgttcaccgtctccagagacaattccaagaatcggtctatctaggaaatgaacagcctgagacgccgaggacaccggccctntattactggtgcgagagactcgaaggacggagtanagacgagcagtctctagaccttacggcggggacccaacgggtaccctgggttacccacccggttctcccgtacaccgtccctacccgaacccgaaccgggtacccctaacggttccccggttccccgtttcccccgaccgggtaccccctacccccgttccctaacccgaaaccggtaccgacccgtaccccggttcgggtccgggggaccacccggaccgggtcccggggtacccccgttggggcccttccgggtacccggttacgggtaacccggtaaccgggtacccttaacccgttacctaccgttacccgtaacctaaccgtacgttacgggacgggccgggtacgtacgggaccgacggtcgacgtacg

SEQ ID NO: 144607 - DNA, 737 bp, Homo sapiens
  misc_feature: GYAE6OF01DB3IW.37.87.H10.1.454.CMB.1.raw
  modified_base (266)..(266): a, c, t, g, unknown or other
  misc_feature (266)..(266): n is a, c, g, or t
  modified_base (450)..(450): a, c, t, g, unknown or other
  misc_feature (450)..(450): n is a, c, g, or t
tcagtagtgtagatcacgaccggtgctcgatttagcagtactgcgttgggtttgggggaggcttggtacagccgtggggggtccctgagactctcctgtgcagcctcgtggtttcatctttagcaactacgccatgagctgggtcccgccaggcctccgaggggaaggggctgggagtgggtctcgaggttattacgtgggtagtggtaaactccgcaatacctacgcaacgacctccggtggaccgggtccgttacacccgttcnccgaagacgtacaatttcccaaaagtaacgtcggttctaagtcgtagggaaaaactggaaaccacgccctaggaagaccggacccggaaggacccctacccgggtcccttacgttaactttacgtggtacgacggaaagtagactccgaaaggtacgggaattagaacgcaagcgtactccgtntaacggtaaccttacgggcgggaaccccaacggtaaccctgggttacccacccgtttctcccgaccgcgtacccctacccgaacccgtaaccgggtccctaccggttccccgttccccttcccccgtacggccccctaccccgtacccgtaccgaacgaccgccctaccgtcggtcgggacacgtaccggcccggtccgtcggctcgtaccgtcgtacgaacgtactacctctactccgtactacttacgtacgacggtcggtacgtggaccgtaacggcgtacgag

SEQ ID NO: 144608 - DNA, 898 bp, Homo sapiens
  misc_feature: GYAE6OF01AJXD8.37.87.H10.1.454.CMB.1.raw
  modified_base (144)..(144): a, c, t, g, unknown or other
  misc_feature (144)..(144): n is a, c, g, or t
tcagtagtgtagatcacgaccggtgctcgatttagcagtactgcgttgggtttgggggaggcttggtacagcctgggggtccctgagactctcctgtgcagcctctggtttcatctttagcaactacgccatgagctgggtccncaggctccgagggaagggctgggagtgggtctcgaggtattacgtggtagtggtaataccgctatactacgcagacctcgtggacgggtccgttcaccgtctccgaggacgacctaattacccgaaaggtaacttacggtcttaacgtctaaggaaaacttacgaaaccacgtccgtaggaaggtacggacccggaacgggaccgtaacccggtccccttagtttaacgtttacctgggtacgtacggaaggtacggtaattaccggaagggtaacgggtaagttaacgtacggaaccgagggacctaacggtcccttacggtacggtaacccggttaaccgggtccgggggaacccctaaccgggtaaaccccgtttcgggtacccctacccggttcctaccccgtacgacccggtacccctaccccgaacccggtaacccggggtaccccctaccggttaccccggtttcccccgttacccccggtacccgggacccccttaacccccgttccccgtaacccggaaaccggtaccgtccccgtaacccggttcggggtccgggggaacccaacccgggaccgggtccccggacccgggttcgggtcccgtacggttccccggtaggtaacccgtaacggttacccttaacccgttaccgaaccgtttcccgtaaccgttaaccgttaccggtaccgggtaccgggacccgggttacggtaccggtaacggaaccgggtccgtccgtaaacgg

SEQ ID NO: 144609 - DNA, 777 bp, Homo sapiens
  misc_feature: GYAE6OF01CCALR.37.87.H10.1.454.CMB.1.raw
tcagtagtgtagatcacgaccggtgctcgatttagcagtactgcgttgggtttggggaggcttggtacagcctgggggtccctgagactctcctgtgcagcctctggtttcatcttagcaactacgccatgagctgggtccgccaggctccgaggggaagggctggagtgggtctcgaggtattacgtggtagtggtaactaccgctatacctacgcagaccgtccgtggaccgggccgttcaccgtctccagacgacaacgttccaaagtaatcggtctagtcgtaggaaattgaactagcctgaacgagccggaggacacggccctactattactgtcgacgagacgataccgaaggacggtagtaagtacgcgaagacaacggtccgttacgtacggtaaccgtaacggtccgggggaaccctaaccgggtaaaccccgttggtaccctaaccccggtcctacccgttaccgaaccggtccccgtaccccgaacccggaaccgggtaccccgtaaccgttccccgggtttcccctttacccccgttacccgggttaccccctacccgtaacccgaacggaccgtcccgtacccgtccgggtacggggacccaccggacggacccgggtcccggtcgggtacccgtcggcccgttacggaccgtaaaccggtacccgttaccgttacccgtaagttaccccgtaacgtacccgttacggtcggaaccgggtcgggtacccgttacgggaaccgaacgggccgtaccgagtaacgg

SEQ ID NO: 144610 - DNA, 766 bp, Homo sapiens
  misc_feature: GYAE6OF01CB0TJ.37.87.H10.1.454.CMB.1.raw
  modified_base (386)..(386): a, c, t, g, unknown or other
  misc_feature (386)..(386): n is a, c, g, or t
  modified_base (758)..(758): a, c, t, g, unknown or other
  misc_feature (758)..(758): n is a, c, g, or t
tcagtagtgtagatcacgaccggtgctcgatttagcagtactgcgttgggtctgggggaggcttggtacagcctgggggggtccctgagactctcctgtgccagcctctggtttcatctttagcaactacgccatgacgcgtcgggtccgccaggtctcccgaagggggaaggggtctgggacggtgggtcctacgtagggttactttacgtggttagtggttaaactacccgctaattaccgtaccgcacgaccgttcccggtggacccggggtcccggttccaccgttcctacccgaaggacacctaaacttccaaaggtaactaccggtattataccggtaggaaacttcggaacacgcctaggacgacggccggaggaaccncccgggtcccttcgttaattcccgtggtcgaccgtaaggacgtactacggacggaacggtaatagtacgcgtagctactccttacgacggtaccgtaccgggtccggggaccctaacccgggtaccgttcggtaccctacccgtcctccgtacgaccgtacccacccgaaccggtacccggaccctacgttcccgttcccgtccccgtccgccctaccccgtccgacccgagaccctaccgtaccgtccgggacgggacctaccggcggtcccggtaccggtcggtcgtcggtccgtcggtaccacggtccctacgttaccgtactaccgaccgtacgactacgggacgggtcccggtagaccggtaccggngccgtacg

SEQ ID NO: 144611 - DNA, 943 bp, Homo sapiens
  misc_feature: GYAE6OF01BA3GE.37.87.H10.1.454.CMB.1.raw
  modified_base (101)..(101): a, c, t, g, unknown or other
  misc_feature (101)..(101): n is a, c, g, or t
  modified_base (124)..(124): a, c, t, g, unknown or other
  misc_feature (124)..(124): n is a, c, g, or t
tcagtagtgtagatcacgaccggtgctcgatttagcagtactgcgttggggtttggggggaggcttggtacagccgtggggggtccctgagactctcctgngcagcctctggttcattctttancaactacgccatgagcgtgggcccgcaggctaccgaggggagggctggaggtcgggtctacgtaggttattacgtaggttagtagtaactacccgacatacctacgcgacggtacccgttccgtacgggacccggggtcccggtttcccaacccggttcctaccgaacggaactaacctaaacgttacccgaaaaggtaacgttaccggttactaagttacggtaacggtaaaattacgaacgaaccgtcgtaggaaacggacggaccggtaacggaacccgacccggttccccgtaatttaacgtttccgtagggtcgaccggtaagggactaacgtacggaagggtaaccggtaacggtataaggcccgaaaggacgtacggtacttacccggtaacgggtaaccgttaccggggaccccggggttaccgaaacccggttaacccggtcggttaccccgtaaccccggtttcaccccgttaccgtaacccgtaccccgtaacccgtaaccccggggaaccggtaccccgtaacccgggtttcccccggttacccccggttacccccgttccgggacccccttaaccccggttaccccgttaaccgaacccgtaaccctacccggtaacccggttccggggtaccgggacccggtaccggaccgggtccccggggtacccggtccggtccgccgggtaccggtacggtaaccggttaacccgtcttaaccccgttaaccgtaccttacccgtaaccgtacccgttagggaccggtcccgggacggtccggaacgggaaccgacgggacgtacggtacg

SEQ ID NO: 144612 - DNA, 751 bp, Homo sapiens
  misc_feature: GYAE6OF01C6QFL.37.87.H10.1.454.CMB.1.raw
  modified_base (274)..(274): a, c, t, g, unknown or other
  misc_feature (274)..(274): n is a, c, g, or t
tcagtagtgtagatcacgaccggtgctcgatttagcagtactgcgtttgggtttgggggaggcttggtacagcctggggggtccctgagactctcctgtgcagcctctggtttcattctttagcaactacgcatgagctgggtccgccaggctccgagggagggctgggagtgggtctcgaggtattactggtagtggtaatccgcatactacgcagtctccgtgaccgggccggttcaccgtctaccagagactaacttccaagaatacggtntatacgtggaaaatgaactacgcctagaacgacgccgaacgggaccaaccggtcccttacgttaactttaacgtcggtaggccgtaagaggtaactcgaacggaagggtaacgtagtaacggcaggacctacggcttacgacgtaccgtaacggtcgggggaacccaccgggtaaaccccgttgggttaacccacccggttctttaccccgcgtacgaccccgtaccaacccggtaacgggacccctacggttccccggttacccgtttccccccgtacgggtccccctaccccgttaccctaacccgaaaccggtacgcccgtaacccggtccggtccgggggaccaaccgtacgggacccggtcccggtcgggccgttcgtcccggtggtaccgaaccgggtactccggttacctcgttacctaacctactacggttacgacggccgggtacgtacgggacgtacgcgttcgaag

SEQ ID NO: 144613 - DNA, 898 bp, Homo sapiens
  misc_feature: GYAE6OF01APZGG.37.87.H10.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
tcagtagtgtagatcacgaccggtgctcgatttagcagtactgcgttgggtctgggggaggcttggtacagcctggggggtccctgagactctcctgtgcagcctctggtttcattctttagcaactacgccatgacgcgtgggtccgccaggctccgagggaaggggctgggagtgggtctcgaggtattacgtggtagtggtaataccgnatactacgcagacgtccgngaccgggccgtttcaccgttcnccgaagacgaactagttaccgaaaggtaacttaccgggtactagttccgtaagggaaaattcggaaactacggtccctaggaacggaccggacccgggaaggaaccccgtacccgggccccctttacgttaaacgtttaccgttaccggtagggaccggtaaaggtaagtaaccgttaccggaaagggaaccggggttaattaaacgtacggaaccgtaacggacccgaggtaccccgtttacgtacggtaacccgtttaaccggggccgggggtaacccctaaacccgggggtaaccccgtttgggtaccccgtaaccccggtttcccttacccgaaccgtacccgtacccccgtaaccccggtaaaccccggtaacccggggtacccccttacgggttccccggtttacccccgttccccccggtacgggccccgttacccccggttcggacccgtaccggtaaccgggacccgaccccgttaacccgaccggtaacggtaccgacccgtaacccggaccgggtccccgggtacccggtcgggtccttccggacccgggttagtaaaccgaaccggttaccttcccttacgacgttaccaccgttaagtccgtaacggccggtacggcgtaggacggtaccgg

SEQ ID NO: 144614 - DNA, 575 bp, Homo sapiens
  misc_feature: GYAE6OF01CHRT6.37.87.H10.1.454.CMB.1.raw
  modified_base (141)..(141): a, c, t, g, unknown or other
  misc_feature (141)..(141): n is a, c, g, or t
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
  modified_base (343)..(343): a, c, t, g, unknown or other
  misc_feature (343)..(343): n is a, c, g, or t
  modified_base (549)..(549): a, c, t, g, unknown or other
  misc_feature (549)..(549): n is a, c, g, or t
  modified_base (570)..(570): a, c, t, g, unknown or other
  misc_feature (570)..(570): n is a, c, g, or t
tcagtagtgtagatcacgaccggtgctcgatttagcagtactgcgttgggtttggggaggcttggtacagccgtgggggtccctgagactctcctgtgcagcctctggtttcatcttagcaactcgccatgagctggtccncaggctccagggaagggctggagtggtctcagggtattactggtatggtaataccgnatacacgcagctccgtgacggccgttacaccgtctcaganaccaattccaagaatcgtactatctggaaaatgaacagccttagagtagcgagactaggccctctattactgtcgacgtagagactacagacgtagtaatacganaagccagcctgtacgacgtacgtgggaccaaacggtaaccctgtacacgtctcgtacagcctccaaccgacggacccgtaatccggttcgttacccccgtcggaccaccctcctacctaaacgacacgtaactcctcggggacacgaacgccgtacccgtggactgaccctgtaccctaagacctagtcctactacgtacactacncgagacggttcagtacaacgnggcag

SEQ ID NO: 144615 - DNA, 880 bp, Homo sapiens
  misc_feature: GYAE6OF01AYNNT.37.87.H10.1.454.CMB.1.raw
  modified_base (148)..(148): a, c, t, g, unknown or other
  misc_feature (148)..(148): n is a, c, g, or t
  modified_base (219)..(219): a, c, t, g, unknown or other
  misc_feature (219)..(219): n is a, c, g, or t
tcagtagtgtagatcacgaccggtgctcgatttagcagtactgcgttgggtctgggggaggcttggtacagcctgggggggtccctgagactctcctgtgcagcctctggtttcatctttagcaactacgccatgacgcgtgggtccnccaggctccgaagggggaagggtctgggaggtgggtctacgaggttattacgtgggtagtggtaataccgnatactacgcagactccgtgacgggccgttacaccgtctccaagacgactaagttaccgaaaggaacttacgggtcttagtacgtaggaaactacgaactacgccgtagaacgtacgaccggaacggaacaccgggtcccctagttaacttaaccgtggtacggacgaacgaagaacgtaccgaaggaaccgggaagttaacgtaacggacgaaccggaccaacggtaccgttaccgtaacggtaaccgtttaaccgggtccggggacccgtaaaccgggtaccccgtaggtaacccgtacccggttacctaccccgttacctacccggtacccgtaacccgaacccggtaaccggggtaccccaaccggttacccggttaccccggtttccccccgtacggtacccccgtaaccccgttacccgttaaccccgaaagtacccggacccgtaacccgtccggggtaccggggacctaaaccgccgggtaccccgggtaccggttaccggggacgtttacgggaccccggttacgggttaaccgtaaaccggttacccgttaaacccttacccgtaaacttacccgttaaacccgtacccttaacgggtaccggtacggggtaccgggaccgggttaaccggacggttaaacggccggtaaag

SEQ ID NO: 144616 - DNA, 604 bp, Homo sapiens
  misc_feature: GYAE6OF02FIFF2.37.87.H10.1.454.CMB.1.raw
tcagtagtgtagatcacgaccggtgctcgatttagcagtactgcgttgggtctggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggcccactcggtcttccccctggccaccctcctcccaacgacgcacctcgtcgggggcacgacgccgggcccgtcggggcctcggcccgttcgggtacctaaacgggtaccttaaccgtttcccgtaacttccttaacccgtaaccttaaccgttacggaacggccgggggaccttcggggccgtaacgggccggaccg

SEQ ID NO: 144617 - DNA, 602 bp, Homo sapiens
  misc_feature: GYAE6OF02GT19T.37.87.H10.1.454.CMB.1.raw
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccggtgacgggccggttcaccgtctccagagacaattccaagaatacggtctatctggaaatgaacagcctgagagccgaggacacggccctctattactgtgcgagagatcagacggagtatagcagcagctctgactacgtgggccacgggaaccctggtcaccgtctcctcacgcctccaccgaacgggcccacgtccgtccttcccccgtcggcccacccgtcctaccaacgacgccaccgtcgtcggggccaccgacgccggcccgtcgggcctcggccgtcggtaccgaacgggtacctaccgttccgacgttcctaacctaaccgttaaccgtacgacggtccgggtcgtacggaccgaacgggccgacgtaacgg

SEQ ID NO: 144618 - DNA, 605 bp, Homo sapiens
  misc_feature: GYAE6OF02GFMGR.37.87.H10.1.454.CMB.1.raw
tcagtagtgtagatcacgaccggtgctcgatttagcagtactgcgttgggtctgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtccaccgtctcctcacgcctccaccaagggcccatccggtcttccccctggccaccctccctaccaacgacgcacctcgtcggggccaccgacgccggcccgtcgggcctcggcccgttcgggtaccgaacggtaccttaaccttacccgtaacttacctaacctaaccttaaccgttacggaacggtccgggggtaccgttcggggaccgtaacgggccgtaaccg

SEQ ID NO: 144619 - DNA, 565 bp, Homo sapiens
  misc_feature: GYAE6OF02I1U1F.37.87.H10.1.454.CMB.1.raw
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgacgactggggccagggaaccctggtcaccgtctcctcacgcctccaccaacgggcccagtccggtccttcccccgtggcccgcccctgcctcccgaggacgccacccgtccggacgacgccacgacggccggcccgtcggggcctcgccgtggtccgaacggactaccgttccatcctacacctacgtcgacggccggctcggcgaggccg

SEQ ID NO: 144620 - DNA, 340 bp, Homo sapiens
  misc_feature: GYAE6OF02FYSIQ.37.87.H10.1.454.CMB.1.raw
  modified_base (271)..(271): a, c, t, g, unknown or other
  misc_feature (271)..(271): n is a, c, g, or t
  modified_base (273)..(276): a, c, t, g, unknown or other
  misc_feature (273)..(276): n is a, c, g, or t
  modified_base (279)..(340): a, c, t, g, unknown or other
  misc_feature (279)..(340): n is a, c, g, or t
tcagtagtgtagatcacgaccggtgctcgatttagcagtactgcgggttggggtttgggacagatttcactctcaccatcagcggcctccagtcgtcgaagattttgcactttagtttctgtcaacactatggtgactgggcctccgtacacttttggccaggggaccaaactggagatcaaacgactgtggctgcaccatctgtcttcatctcccgcatctgaatctacactacgtgagtcgggctgggctaagggcacaattaaggtgntnnnncgnnnnnnnnnnnnnnnnnnnnnnnnnnnnnnnnnnnnnnnnnnnnnnnnnnnnnnnnnnnnnn

SEQ ID NO: 144621 - DNA, 259 bp, Homo sapiens
  misc_feature: GYAE6OF02GAO44.37.87.H10.1.454.CMB.1.raw
  modified_base (254)..(259): a, c, t, g, unknown or other
  misc_feature (254)..(259): n is a, c, g, or t
tcagtagtgtagatcacgaccggtgctcgatttagcagtactgcgttgggtttgggacagatttcactctcaccatcagcggcctccagtctgaagatttgcactttatttctgtcaacactatggtgactggcctccgtacacttttggccaggggaccaaactggagatcaaacgaactgtggctgcaccatctgtcttcatcttccgccatctgaatctacactactgagcgggctggcaaggcgcatagnnnnnn

SEQ ID NO: 144622 - DNA, 550 bp, Homo sapiens
  misc_feature: GYAE6OF02GZSAB.37.87.H10.1.454.CMB.1.raw
  modified_base (528)..(528): a, c, t, g, unknown or other
  misc_feature (528)..(528): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactgggccacggaaccctggtcaccgtctcctcagcctccaccaagggcccactccggtcttcccccgtcgccacccctcctcccaacgacgccaccctctcgggggcaccgacggccggccctggggcctcgccgtcggtcgaacggactacttccatcctaacactacngagcggctggcgaacggcgcag

SEQ ID NO: 144623 - DNA, 603 bp, Homo sapiens
  misc_feature: GYAE6OF02JERWJ.37.87.H10.1.454.CMB.1.raw
tcagtagtgtagatcacgaccggtgctcgatttagcagtactgcgttgggtctgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagatacgtctatctggaaatgaacagcctgagagccgaggacacggccctctattactgtgcgagagatcagacggagtatagcagcagctctgactacgtggggccaacgggaaccctggtccaccgtctccctcacgcctccaccgaacggcccacgtccggtccttcccccgtcggccctaaccccgttccctacccgaaacgtacgacctaccctccggtacgggggccaccgaacggccgggtcccgtcgggccttcgcccgttgggtaccaacgggaccttacttcccattcctacaaccttaccgtagacggtccgggacgtcggaccgacgggcgtacg

SEQ ID NO: 144624 - DNA, 571 bp, Homo sapiens
  misc_feature: GYAE6OF02I83IO.37.87.H10.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (317)..(317): a, c, t, g, unknown or other
  misc_feature (317)..(317): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
tcagtagtgtagatcacgaccggtgctcgatttagcagtactgcgttgggtctgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtcncaganacaattccaagaatacggtctatctaggaaatgaacagcctgagagccgaggacacggccctctattacngtgcgagagactcagacggagtanagcagccagctntgactacgtggggaccaacggaacccttggtcacccgtctccncncgcctccaccgaacggcccacgtccggtccttcccctcggccgtccctcgcctccgacggacgcaccgtccgagacgcacgacgccggccctgggctcgccgtggaccgtaacggacctaccgtccacttccaccgtactaccgtcggacgccgggacgtccggacgtaacgg

SEQ ID NO: 144625 - DNA, 542 bp, Homo sapiens
  misc_feature: GYAE6OF02FQWFG.37.87.H10.1.454.CMB.1.raw
  modified_base (525)..(525): a, c, t, g, unknown or other
  misc_feature (525)..(525): n is a, c, g, or t
  modified_base (540)..(540): a, c, t, g, unknown or other
  misc_feature (540)..(540): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggccccactccggtccttccccctcggcccacccctccctccaacgacgccaccctcgtcggggccacgacgccggccctgggcctcgcctggtcaagactactccactctacactacngagcggctggcagcnag

SEQ ID NO: 144626 - DNA, 588 bp, Homo sapiens
  misc_feature: GYAE6OF02J099I.37.87.H10.1.454.CMB.1.raw
  modified_base (312)..(312): a, c, t, g, unknown or other
  misc_feature (312)..(312): n is a, c, g, or t
  modified_base (341)..(341): a, c, t, g, unknown or other
  misc_feature (341)..(341): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctaggaaatgaacagcctgagagccgaggacacggccctntattactgtgcgagagatcagacggatanagcagcagctctagactacgtggggacccaaccggaaccctggtaccacccggtctccctcacgccctacccaccgaacggccctacgtccggttcccttccccgtcgccctaccctccctacccgaacgacgaccaccgtccggcggggccacgacggccggcccgtcgggcctcgccgtgtcgaacgtacctacctccactctacctactacgtcgacggcggtcgcggacgacggcgacgtacg

SEQ ID NO: 144627 - DNA, 635 bp, Homo sapiens
  misc_feature: GYAE6OF02JE1UF.37.87.H10.1.454.CMB.1.raw
  modified_base (206)..(206): a, c, t, g, unknown or other
  misc_feature (206)..(206): n is a, c, g, or t
tcagtagtgtagatcacgaccggtgctcgatttagcagtactgcgttgggtctgggggaggcgttggtacagcctggggggtccctgagactctcctgtgcagcctctggtttcatttttagcaactacgccatgagctgggtccgccaggctccagggagggtctggagtgggtctcgaggtattactggtagtggtaataccgnatactacgcgaggactccgtgacgggccggttcaccgtctaccagacgactaattcccaagaactcggtctatctggaaatgaacagcctgagacgcaggacacggccctgtacttactgtagcgagagagtcgaggacggatatagcagcagctctagactacgtgggaccacggaaccctggtaccaccgtcctcctagacgccctccaaccgaacggccccagtccggtaccttcccccgtacggccctacccgtcctaccaacgtacgtccacctccgtacggggtaccacgacggtacccggacccgtcgggtaccgtcggtcccgtcggtaccgtaacgtaccgttaccgttaccgacgttaccgtaaccgtaacgtaccgtacgacggacgggtacgtcgggtacgaacggccggtacgacg

SEQ ID NO: 144628 - DNA, 585 bp, Homo sapiens
  misc_feature: GYAE6OF02IZO1W.37.87.H10.1.454.CMB.1.raw
tcagtagtgtagatcacgaccggtgctcgatttagcagtactgcgttgggtttgggggagggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccaacggaaccctggtccaccggtctacctcacgccctaccaccaacgggccccatccggtcctttccccctcggccacccctcctaccaacgacgccacctcgtcggggccacgacgccggcccgtcgggctcgccgtcggtacgaacggaccttaccgtaccactcccgtaactacctaccgtcggacggccgggactcggacgaacggcgactaacg

SEQ ID NO: 144629 - DNA, 259 bp, Homo sapiens
  misc_feature: GYAE6OF02GH3YC.37.87.H10.1.454.CMB.1.raw
  modified_base (256)..(259): a, c, t, g, unknown or other
  misc_feature (256)..(259): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttccgccatctgaatctacactactgagcgggctggcaaggcgcataggnnnn

SEQ ID NO: 144630 - DNA, 683 bp, Homo sapiens
  misc_feature: GYAE6OF02JZX4I.37.87.H10.1.454.CMB.1.raw
  modified_base (148)..(148): a, c, t, g, unknown or other
  misc_feature (148)..(148): n is a, c, g, or t
  modified_base (192)..(192): a, c, t, g, unknown or other
  misc_feature (192)..(192): n is a, c, g, or t
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
tcagtagtgtagatcacgaccggtgctcgatttagcagtactgcgttgggtttgggggaggcgttggtacagcctggggggtccctggagactctcctgtgcagcctctggtttcattctttagcaactacgccatgagctgggtccnccaggctccgagggaagggctggagtgggtctcaggtattacgnggtagtggtaataccgnatactagcagactccgngaccgggccgttnaccgtctcagacgacaattccaagaatacggtctatctaggaaatgaacngcctgagaacgccgaggaccaccggtccctacgtattaccnggtcgacggtaagacgtatacgaggaacggtagtatagccagacgagctacgngaacgttccggnggggaccctaaccgggaaccttggggaccctacccgggttctacccgtcgaaccgtccctacccgaccgtaacgggccctacgtaccggtcccgttccccgtccggaccctaccccgtaccttccgaacgacgcccgtaaccgtcggtacggggacaccggtacggcccgggtacccgtcggggtccgttccggtccgtacggtacgtaacggtacctaccgttacctaccgtccttaaccgacctacgttagacggtccggcgtacggacgacggaccgtacgtacg

SEQ ID NO: 144631 - DNA, 664 bp, Homo sapiens
  misc_feature: GYAE6OF02FTS17.37.87.H10.1.454.CMB.1.raw
tcagtagtgtagatcacgaccggtgctcgatttagcagtactgcgttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctaggaaatgaacagcctgagagccgaggacacggccctctattactgtgcgagagatcgagacggagtatagcagcagctcgtgactacgtggggaccaacggaaccccttgggtccaccggttcctccctcacgccctcccaacccgaacgggccccacgttccggttccctttcccccgtcggtcccaccccgtcccttacccgaacgtacgaccgtaacccgtccggtcgggggaccaaccggaccggcccgggtccccgttcggggtccgttcgggtcccgttacgggtaccgtaacggtaacctttaccgttacctaacgttacctaaccgtaaccttaacgtcggacggtccgggccgtacggacggaacggtccggactaacg

SEQ ID NO: 144632 - DNA, 259 bp, Homo sapiens
  misc_feature: GYAE6OF02GWEHB.37.87.H10.1.454.CMB.1.raw
  modified_base (255)..(259): a, c, t, g, unknown or other
  misc_feature (255)..(259): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgcatctgaatctacactactgagcgggctggcaaggcgcatagnnnnn

SEQ ID NO: 144633 - DNA, 624 bp, Homo sapiens
  misc_feature: GYAE6OF02FZ3XT.37.87.H10.1.454.CMB.1.raw
tcagtagtgtagatcacgaccggtgctcgatttagcagtactgcgttggggtcctacggggaggccttggtacgagcctcggggggtccctgagactctcctgtgccagccgtctggtttcagtctttagcaacttacgccagtgagctgggtaccgccgaggcctccacgggaaggggctggagtgggtctcgaggtagttactggtagtggtaataccgcatactacggcagactccgtagacgggccgttcaccgtcgtccagagacaatttccaaagtaatacggtctatcgtggaaatggaacagccctgagagccgaggacacggccctgtattacgtgtgacgagagtactacgaggacggagtaatagcaggcaagctactgacgtacgtggggaccaaccggaaccctggtacccaacccgtctacccgtacacgccctacccaaccgaacgggacccacgtccgtacccgttccccgtcggccctacccgtccgtaccgaacgtacgcctaccgtcgtcggggaccaccgacggccgtccgtggcctgccgtgacgaacggactacgtactactcctacgtactacgtgtacgcggtcgtggacgaggcctacg

SEQ ID NO: 144634 - DNA, 257 bp, Homo sapiens
  misc_feature: GYAE6OF02GQFL2.37.87.H10.1.454.CMB.1.raw
  modified_base (256)..(257): a, c, t, g, unknown or other
  misc_feature (256)..(257): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccatctgaatctacactactgagcgggctggcaaggcgcatagnn

SEQ ID NO: 144635 - DNA, 563 bp, Homo sapiens
  misc_feature: GYAE6OF02GJAHA.37.87.H10.1.454.CMB.1.raw
  modified_base (359)..(359): a, c, t, g, unknown or other
  misc_feature (359)..(359): n is a, c, g, or t
tcagtagtgtagatcacgaccggtgctcgatttagcagtactgcgttgggtctgggggaggcttggtacagcctgggggggtccctgagactctcctgtgcagcctctggattcaacttttggtagctattggatggactgggtccgccaggttccagggaaggggctggagtgggtggccaacataaagcaagatggaagtgagaaatactatgtggactctgtgaagggccattcaccatctccagagacaacgcccagaactcattgtatctgcaaatgaacagactgagagccgaggacacggctgtgtattactgtgcgagagaggagcgattagtgtaaatggctgggccttntactactactactacatggacgtctgggcaaacgggaccacggtcaccgtctcctcacgcctccaccgaacggcccacgtccgtccttccccgcgccaccctccctaccaacgacgcacctcgtcggggacacgacgcggcccgtcgggcctcggccgtacggtcgaacggtaccttaccgttacctacgttacctactaaccg

SEQ ID NO: 144636 - DNA, 630 bp, Homo sapiens
  misc_feature: GYAE6OF02HD28V.37.87.H10.1.454.CMB.1.raw
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
tcagtagtgtagatcacgaccggtgctcgatttagcagtactgcgttggggtttgggggaggcttggtacagcctgggggggtccctgagactctcctgtgcagcctctggtttcatctttagcaactacgccatgagctgggtccgccaggctccgaggggaagggggctgggagtgggtctcaggtattactggtagtggtaataccgcatactacgcagactccgtggaccgggccggttcaccgtctccagagacaattccaagaatacggtctatctaggaaatgaacagcctggagagccggaggaccncggccctntattacctgtgcgagagatcaaggacggatagtagcagcaagctagtcgaccttacggcggggacccacgggtaaccctggtccacccgttctccctcgacgccctacccaacccggaaccgggcccctagttcccggttaccctttcccccgtacggtcccctaccccgtccctaccgaaacgcaccaccgtcggaccggggcaccgacggccggtcccgtgggcctcggccgtcggacgaacgtacctactaccactcctaaccacgtacgtcggacggcgggtacgcggaacgacggccagtag

SEQ ID NO: 144637 - DNA, 577 bp, Homo sapiens
  misc_feature: GYAE6OF02JI1ZT.37.87.H10.1.454.CMB.1.raw
  modified_base (404)..(404): a, c, t, g, unknown or other
  misc_feature (404)..(404): n is a, c, g, or t
  modified_base (550)..(550): a, c, t, g, unknown or other
  misc_feature (550)..(550): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaaggggctggagtgggtctcaggtattactgggtagtggtaataccgcatactacgcagactccgtgacgggccggttcaccgtctccagagacaattccaagaatacggtctatctggaaatgaacagcctgagagccgaggacacggccctctattaacctgtgcgagagatcagacggagtatagcagcagctctgactactggggccacggaaccctggtcaacccgtctccctcacgcccnccaccaacgggccccagtccggtccttcccccgtcggccacccctcctcccaacgacgccacctccgtcggggccaaccgcgccggcccgtgggccgtcgccgtcggtacgaacggacctaccttccacgtcctaactaccgtacncggagcggctcggacgacggcgctacg

SEQ ID NO: 144638 - DNA, 703 bp, Homo sapiens
  misc_feature: GYAE6OF02I3NR5.37.87.H10.1.454.CMB.1.raw
  modified_base (208)..(208): a, c, t, g, unknown or other
  misc_feature (208)..(208): n is a, c, g, or t
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
tcagtagtgtagatcacgaccggtgctcgatttagcagtactgcggttgggtctgggggaggcttggtacagcctggggggtccctgagactctcctgtgcagcctctggtttcatctttagcaactacgccatgagctcgggtccgccaggctccgaggggagggctggacgtgggtctcgagggtattacgtgggtagtcggtaancccggcattacctacgcaaggaccttccggtgaccggggccggtttcaccggttctaccgagacgactaacttccgaaagaactacggtctaagttcgtggaaaatggaaacagtccgtggagacggtccggaggacctaccgggccctcttaagttacctggcgcgagagcttcaaggacggagtatacgngtaagctaggccttgngaacctaggtacgggggaccaaccgggtaaccccttggggtaccccaccggttcctccctacgtaacgtaccctacccgaaccgaacgggcccgtacgttccggtcccttccccgtcggcctacccgtccctaccgacgacgccctacgtcggtacggggcacgcgaccggcccgttcgggccgtcggccgttacgggaccgtaacgtaccgtacctaccgtactacccgttacgtaaccgtacgttacggcggaccgggtccggtacggtaccgacggcgtaaccg

SEQ ID NO: 144639 - DNA, 747 bp, Homo sapiens
  misc_feature: GYAE6OF02IEVAG.37.87.H10.1.454.CMB.1.raw
  modified_base (145)..(145): a, c, t, g, unknown or other
  misc_feature (145)..(145): n is a, c, g, or t
  modified_base (283)..(283): a, c, t, g, unknown or other
  misc_feature (283)..(283): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccnccaggctccagggaagggctggagtggtctcgaggtattactggtagtggtaaataccgcatactacgcagactccgtggacgggccgttcaccgtctcagagacaattccaagactcggtctatcaggaatcgaacngcctgagagccgagaccacggcctctattactgtgacgagacgactcgaggacggagtaacgtagacagcagtcctcgtagaccgttacgtcgggaccaaccggtacccgtggtaccctacccggtccttacccgtacgaccgtaccctacccgaacccgaaaccgggtcccctacgttcccgggttcccttcccccggtcggccctaccccgtaccttacccgaacgaccgtccgtaacccgttcggtaccgggggaccaaccggtaccgggacccgggtccccggttcggggtacccgttccgggtacccggttaccgggtaaccggtaacggttacccgttacccgtttacccgttaaccgttaaccgtaacccgtttaacccggttaccgggtacggggtaaccgggtcccgggttaccggtaacggggtacccggtaaacgggtcccggtacctaacgg

SEQ ID NO: 144640 - DNA, 608 bp, Homo sapiens
  misc_feature: GYAE6OF02GHHNK.37.87.H10.1.454.CMB.1.raw
  modified_base (347)..(347): a, c, t, g, unknown or other
  misc_feature (347)..(347): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccagggaagggctggagtgggtctcgaggtattactggtagtggtaaataccgcatactacgcagactccgtgacgggccgttcaccgtctccagagacaattccaagaatacggtctatctaggaaatgaacagcctagagagccgaggaccacggccctatattactgtgcgagagactcaaggacggagtanacgcagcagctctagactacgtcgggaccacggtaaccctggtccaccggtntcccgtnacgccctaccaccgaacggcccacgtccggtccttccccgacggccctacccgtcctaccaacgacgcctacctcggtgggaccacgacggccggtaccgtgggctcgccgtggtacgaacggtacctaccgttaccagttacctaaccgtacctaacgtcgaacgggccgggacgtacggaacgtacggacgtactaacgg

SEQ ID NO: 144641 - DNA, 257 bp, Homo sapiens
  misc_feature: GYAE6OF02GTI6I.37.87.H10.1.454.CMB.1.raw
  modified_base (254)..(257): a, c, t, g, unknown or other
  misc_feature (254)..(257): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgcctatctgaatctacactactgaggcggctgcaggccatagnnnn

SEQ ID NO: 144642 - DNA, 628 bp, Homo sapiens
  misc_feature: GYAE6OF02HYCG4.37.87.H10.1.454.CMB.1.raw
  modified_base (281)..(281): a, c, t, g, unknown or other
  misc_feature (281)..(281): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagtagtgtagatcacgaccggtgctcgatttagcagtactgcgttgggtctgggggaggcttggtacagcctgggggggtccctgagactctcctgtgcagcctctggtttcatctttagcaactacgccatgagctgggtccgccaggctccgaggggaaggggctgggaggtgggtctcgaggtattactgggtagtggtaactaccgcatactacgcagactccggtgaccgggccggttccaccgtctccagagaccaattccaagaatacggtntatctggaaatgacagcctgagagccgaggacaccggcccttntattactgtgcgagacgatcaggacggtagtaatagcagcagtctncgactgcgggcctaacgggaccctgtccaccgttcctccctacgacgccctccgaaccgtaacgggccctacgtccggtcccgttccccgtcggccctacccctcccgtaccgaaacgcctaccgacccgtcggtacggggccacgaccggccgggccgtcgggctcggccgtcggtacgaaccggtacttaccgttaccgtaactcctaacctacgttaccgtgaccggtcgggaccgtggacggaccggcgtaacg

SEQ ID NO: 144643 - DNA, 757 bp, Homo sapiens
  misc_feature: GYAE6OF02GJ2OK.37.87.H10.1.454.CMB.1.raw
  modified_base (366)..(366): a, c, t, g, unknown or other
  misc_feature (366)..(366): n is a, c, g, or t
tcagtagtgtagatcacgaccggtgctcgatttagcagtactgcgttgggtctgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcatccgtctccagagacaattccaaagtaatacggtctatctaggaaatggaaacagcctagagacgccgaggaccacggccctctattactgtgcgtaagagatcgagacggagtatagcagcagcttcngacctacgtcggggacccaacggtaaccctgggtaccacccgtctcctcgacgccctacccaaccgaacgggccctacgttccgggttccctttccccccgtacggtcccctaccccgttacccctacccgaaacggtaccgtacccgtacccgttaccgggttaccgggggacccaaccgtaacccggggtccccggggaccccccgtttagggggccccgtaccgggtccccgtttacggggttaaccccggaaccgggttaaccctttaaccccggtttacccccgtaaccgtttaaccccgttaacccgtaaaccccgtttaccgtaacgggaccggggtacccggggttacccggtaccggggtacccgtaaacggggaccccggg

SEQ ID NO: 144644 - DNA, 774 bp, Homo sapiens
  misc_feature: GYAE6OF02F3ZI1.37.87.H10.1.454.CMB.1.raw
  modified_base (145)..(145): a, c, t, g, unknown or other
  misc_feature (145)..(145): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccnccaggctccaggcatggggctgcagtgggtctccaagtactagtgctcctagggtaatagagcagactacgcagacctccgtaggaacgggtcccggttacaccattccnccaganactaattccaagaacacgctactatctanacaaatgaacngctgagacgaccgaagacacggccgtatacgttactagttgtaggaaacggcggtaggggaggtacgggggaactacgggtcggggaccgacgggtaacccgtggtaccgaccgttctacctacgacgaccctacccgtaaccggacggtaccctacgttccggttccctttacccccggtggaccctaccccgttacccgaaccgaacgtaccgcccgttaccgtccgggtaccgggggaccctaaccgggaccggtcccggggacccggttaccggggtaccgtttcccggggtacccgttaccggggtaaccttaaaaccggggttaccctttaaccgtttaccccgtaaccgttacccgtttaacccgaaccgtttaacccggtaaccgggacgggttaccccggggttaccgtttaggggaaccccggtaaggggtacccgaccgggttaaacgtacgggtactaacg

SEQ ID NO: 144645 - DNA, 708 bp, Homo sapiens
  misc_feature: GYAE6OF02JNDI6.37.87.H10.1.454.CMB.1.raw
  modified_base (208)..(208): a, c, t, g, unknown or other
  misc_feature (208)..(208): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (372)..(372): a, c, t, g, unknown or other
  misc_feature (372)..(372): n is a, c, g, or t
  modified_base (704)..(704): a, c, t, g, unknown or other
  misc_feature (704)..(704): n is a, c, g, or t
tcagtagtgtagatcacgaccggtgctcgatttagcagtactgcgttggggtctgggggaggcttggtacagcctgggggggtccctgagactctcctgtgcagcctctggtttcatctttagcaactacgccatgagctgggtccgccaggctccaggggaaggggctggagtgggtctcgagtattactggtagtggtaatccganatactacgcagaccgttccgtggaccgggccgttcaccgtctcagngacaattccaaagtatacgtctatcgaggaaangaacngcctgagagccgaaggcacggcccttagtattactgtcgagagaggtatcgagacgggtatgtagcgaagcagcttacgngtaaccgtaggtcgggaccctaaccggggtaacccttaggtccccggtactccctttacccgtaccgccggtaccccctacccgaaaccgggaacccgggtaccctacggttccggttcccttcccccgtacggtccctaccccgttacccttacccgaacggtacctaccgacccggtacggtcggggactacccgacggtcccgggacccgttccgggaccgtttccgggtcccggtaacgggttacgtaaccggtacggttaaccgcggggtaacggtccggggtacgggaccggtaccgggtaacggcggtccgtacgtagcgtcggngtac

SEQ ID NO: 144646 - DNA, 639 bp, Homo sapiens
  misc_feature: GYAE6OF02JG1MQ.37.87.H10.1.454.CMB.1.raw
  modified_base (315)..(315): a, c, t, g, unknown or other
  misc_feature (315)..(315): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccgagggaagggctggagtgggtctcaggtattactggtagtggtaataccgcatactacgcagactccggtgacgggccgttcaccgtctccagacgacaattccaaagaatacggtctatctaggaaatgaacagcctgacgagccgaggacacggccctntatactggtgcgagagatcgaggacggagtatagacagcagctcgtagacctacggtcggggaccaacgggtaacccgtggtacccaccggttctcccgtcacgccctaccgaccgacggaccctacgtccggtccttccccgtcggtaccctaccctccgtaccaacgacgcctaccgtccggtcggggacctacgaccggccggtcccgtcgggtaccgtcggccgttacggtaccgaacgttaccgttacgttaccgtacgttacctaacctaccgtacgtacggacggcgggtcgtacggaccgtacggccgtcgtaacg

SEQ ID NO: 144647 - DNA, 307 bp, Homo sapiens
  misc_feature: GYAE6OF02I1G7K.37.87.H10.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (266)..(266): a, c, t, g, unknown or other
  misc_feature (266)..(266): n is a, c, g, or t
  modified_base (272)..(307): a, c, t, g, unknown or other
  misc_feature (272)..(307): n is a, c, g, or t
tcagtagtgtagatcacgaccggtgctcgatttagcagtactgcgttgggtttgggacagatttcactctcaccatcagcggcctccagtctgaagattttgcactttatttctgtcaacactatggtgactggcctccgtactacttttggccagggggaccaaactggagatcaaacgaactgtggctgcacatctntcttcatcttcccgcatctnaatctactactactgacgcggtctggcgaaggcgacacttaaggacngtcagnnnnnnnnnnnnnnnnnnnnnnnnnnnnnnnnnnnn

SEQ ID NO: 144648 - DNA, 592 bp, Homo sapiens
  misc_feature: GYAE6OF02FFJZC.37.87.H10.1.454.CMB.1.raw
  modified_base (206)..(206): a, c, t, g, unknown or other
  misc_feature (206)..(206): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (458)..(458): a, c, t, g, unknown or other
  misc_feature (458)..(458): n is a, c, g, or t
tcagtagtgtagatcacgaccggtgctcgatttagcagtactgcgttgggtttgggggaggcttggtacagcctggggggtccctgagactctcctgtgcagcctctggtttcatctttagcaactacgccatgagctgggtccgccaggctccgagggaagggctggagtgggtctcaggtattacgtggtagtggtaataccgnatactacgcagactccgtgacgggccgttcaccgtctccagacgacaattccaagaactacggtctatctggaaatgaacagcctgagacgccgaggacacggccctctattacngtgacgagagatcgaagacggtagtatagcagcagctcngactcgngggaccacggacctggcaccgtctccncgacncctccaccgaacggccctacgtccgttccgtcccctcggccaccctcctaccaaggccnccaccgtcgtcggggactacgacggccggaccgtcggccgttcgccgtcggtacacgacgttacctaccacgttaccaaccgtacctaaccgtacggaccggcgggtaccgtacgggacgacggccgactaacg

SEQ ID NO: 144649 - DNA, 750 bp, Homo sapiens
  misc_feature: GYAE6OF02GM5UY.37.87.H10.1.454.CMB.1.raw
  modified_base (144)..(144): a, c, t, g, unknown or other
  misc_feature (144)..(144): n is a, c, g, or t
  modified_base (188)..(188): a, c, t, g, unknown or other
  misc_feature (188)..(188): n is a, c, g, or t
  modified_base (219)..(219): a, c, t, g, unknown or other
  misc_feature (219)..(219): n is a, c, g, or t
tcagtagtgtagatcacgaccggtgctcgatttagcagtactgcgttgggtttgggggaggcttggtacagcctggggggtccctgagactctcctgtgcagcctctggttcattctttagcaactcgccatgagctgggtccnccaggctcgaggggagggctggagtggtctcgaggtatttacgnggtagtcggtaaataccggcaactactacgntagaccttccggtaggaccgggtccggttcaaccggtctaccgaagacgtaacaacgttccaaagaacttccggtctatccgtaggaaaactgaaactacgaccgtaggacgtacggaccggtaacggacgaccggtcccttatacttaaccgtgtcggacaggacgtacgtacgaacggacgggtaagttacgtacggactacggaactacggtccttcgttacggaaccttaacgggtccgggggaacccttaccgggaaaccgttcggtaacccgtaccgttcccggttaacctccgggtaacacccgttacccgaaaccggaccgtcccgtaacggtttccgttcccgttacccgtcggacccttacccgtccgtacaacgtacgtccacgttccgggacggcctaacgcgtcccggtcggtacgtccgcgtccgtacggtaacgtaacgttcccgtacttccgttaccgaccgttactacccggtattacggcggaccggcgtaccggactaggtccgtacgtacg

SEQ ID NO: 144650 - DNA, 669 bp, Homo sapiens
  misc_feature: GYAE6OF02HK09R.37.87.H10.1.454.CMB.1.raw
  modified_base (359)..(359): a, c, t, g, unknown or other
  misc_feature (359)..(359): n is a, c, g, or t
tcagtagtgtagatcacgaccggtgctcgatttagcagtactgcgttgggtttgggggaggcttggtacagcctggggggtccctgagactctcctgtgcagcctctggattcacctttggaagctttgccatgagctgggtccgccaggctccagggaagggctggaatgggtctcagccattagtagtagtggtggaagcacgtactacgctgactccgtgaacgggccgttcgccctctccagacgacaactccaacaacacgctgtctctgcaacttaacgagtcctagagagacgaggacacggccgtatacttactgtgacggaaggaagggtctagcagtcgcctggtaccnccctactactatacgtggacgtcgtaggggacaaaagggatcggtcggtaccacccgttactccctacgacgtccctacccgaacccgaaccgggcccacgttcccggttcccttccccgtcgccctacccctcccgtaccgaacgaccgacctaacccgttccggacggggtaccaccgacggaccggtccccgtgggtcctcggtccgttacggtacgaaacggtacccgttaacctttaccgacttaacccgtaacctaaccgttacctacgggaccgggtccgggtcgaccgggtacgtaaccggg

SEQ ID NO: 144651 - DNA, 791 bp, Homo sapiens
  misc_feature: GYAE6OF02IJNV7.37.87.H10.1.454.CMB.1.raw
  modified_base (776)..(776): a, c, t, g, unknown or other
  misc_feature (776)..(776): n is a, c, g, or t
tcagtagtgtagatcacgaccggtgctcgatttagcagtactgcgttgggtttgggggaggcttggtacagcctggggggtccctgagctctcctgtgcagcctctggtttcatctttagcaactacgccatgagctgggtccgccaggctccgaggggaagggctggagtgggtctacgaggttattaacgtggttaggtacggttaataccggcaattaccgtaacgcaaggtaccgtcccggtagggtaccgggtccggtttaccacccggttcctacccgaaggtaacggaacctaaacgtttaccgaaaagtaataccgggttacttaagtacttagggaaatagaacgacgcctaggaggaaggccggtaaggaccgaccgggacctacgttaagttaacgtcggttaggacgacggtaagtacaccgtaagggacggtaagttataacggacgaacgtacgaacgtacgttactaggaccgttaacggtcggggaacccaacccggtaccgtaggtcccaaaccgttccctactccgagtacccgtaccaaaccggaccgggtaccctaacgtacccgtttacccgttccccgacggtacccgtacccctaaccgtaccgtaacgacgttacccgacgttacggcgggacctaacggacggcccggtccgcgggtccgtcgtccggtacgaccgtaacgggtaaccctacggttacctaacggtacctacgtaacgttacgacggacggtcggttacgtaggaacccgngggtacacccgtaag

SEQ ID NO: 144652 - DNA, 517 bp, Homo sapiens
  misc_feature: GYAE6OF01A3MMC.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcataccgggagcaccaactacaatccgtccctcaagagtcgagtcaccatatctatagacacgtcgaacaaccagttctcctgaagtgacctctcgtgaccgccgcgacacggccgtctattactgtgcgcgatttcagaggacaggtactactatatgcgtcgg

SEQ ID NO: 144653 - DNA, 410 bp, Homo sapiens
  misc_feature: GYAE6OF01BXFLU.5.23.C01.1.454.CMB.1.raw
  modified_base (402)..(410): a, c, t, g, unknown or other
  misc_feature (402)..(410): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcgggctggcaaggcgcatagnnnnnnnnn

SEQ ID NO: 144654 - DNA, 445 bp, Homo sapiens
  misc_feature: GYAE6OF01CWXLT.5.23.C01.1.454.CMB.1.raw
  modified_base (411)..(445): a, c, t, g, unknown or other
  misc_feature (411)..(445): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacagggactactatatcgacgtctggggcagagggaccacggtcatcgtctcctcagcctccaccaagggcccatcggtctccccctggcaccctccgtccaagacgcacctctgggggcacgagcggcccgtgggctgcctggtcaaggactacttcccgtgtctgatctgagcggctggcgaagggcgcagtagcagnnnnnnnnnnnnnnnnnnnnnnnnnnnnnnnnnnn

SEQ ID NO: 144655 - DNA, 407 bp, Homo sapiens
  misc_feature: GYAE6OF01AI4AB.5.23.C01.1.454.CMB.1.raw
  modified_base (402)..(407): a, c, t, g, unknown or other
  misc_feature (402)..(407): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcgggctggcaaggcgcatagnnnnnn

SEQ ID NO: 144656 - DNA, 406 bp, Homo sapiens
  misc_feature: GYAE6OF01A8MXJ.5.23.C01.1.454.CMB.1.raw
  modified_base (400)..(406): a, c, t, g, unknown or other
  misc_feature (400)..(406): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggccctgggctgcctggtcaaggactacttcccgtgtctgatctgagcggctggcaaggcgcatagnnnnnnn

SEQ ID NO: 144657 - DNA, 403 bp, Homo sapiens
  misc_feature: GYAE6OF01CC1W5.5.23.C01.1.454.CMB.1.raw
  modified_base (400)..(403): a, c, t, g, unknown or other
  misc_feature (400)..(403): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcggctggcaggcgcatagnnnn

SEQ ID NO: 144658 - DNA, 527 bp, Homo sapiens
  misc_feature: GYAE6OF01BM7XP.5.23.C01.1.454.CMB.1.raw
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaacgaggctgggagtggattggggagatctatcagtaccgggagcaccaactacaatccgtccctcaagagtcgacgtcaccatatctatagacacgtcgaacaaccagttcncctgaagtnactctgtcgaccgccgcggacacggcctctattactgtcgcgtcggatttcgagagggacaggtactactatatcgacgtcgg

SEQ ID NO: 144659 - DNA, 523 bp, Homo sapiens
  misc_feature: GYAE6OF01D8NWT.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcgggaccctgtccctcacctgcgatgtttctcgtggctccatcagcactattaatggtggacctgggtccgccagcccccaggaagaggctggagtgggattggggagatctatcataccgggagcaccaactacaatcccgtccctacaagagtcgagtcaccatatctatacgacacgtcgaacaaccagtctccctagaacgtgactctgtgaccgccgcggacacggcctctattactgtgcgcggatttcgagagggacaggtactactatactcgcgtcgg

SEQ ID NO: 144660 - DNA, 606 bp, Homo sapiens
  misc_feature: GYAE6OF01DVFZH.5.23.C01.1.454.CMB.1.raw
  modified_base (372)..(372): a, c, t, g, unknown or other
  misc_feature (372)..(372): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggaccgtgggtccgccgacgcccccgaaggaagaggctaggagtggagttggggatagtctatcagtaccggganccgaaccaactacaactccgtaccctacgaacgacgtacgagtccaaccgattaactactaatagacacgtaccgaaactaacccacgtttctacccgtagaacggtcgtaccgtcgtaggtacgacccggtcccggacggtaaccgaccggtaccgttactaacttacgtcgtcgccgtcggtatttacgaggacgggtacacgggtactacgtataacgtcgtacggtcggg

SEQ ID NO: 144661 - DNA, 410 bp, Homo sapiens
  misc_feature: GYAE6OF01BLHEM.5.23.C01.1.454.CMB.1.raw
  modified_base (403)..(410): a, c, t, g, unknown or other
  misc_feature (403)..(410): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcgggctggcaagggcgcatagnnnnnnnn

SEQ ID NO: 144662 - DNA, 405 bp, Homo sapiens
  misc_feature: GYAE6OF01EL6GR.5.23.C01.1.454.CMB.1.raw
  modified_base (401)..(405): a, c, t, g, unknown or other
  misc_feature (401)..(405): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcggctggcaaggcgcatagnnnnn

SEQ ID NO: 144663 - DNA, 409 bp, Homo sapiens
  misc_feature: GYAE6OF01CKJSE.5.23.C01.1.454.CMB.1.raw
  modified_base (406)..(409): a, c, t, g, unknown or other
  misc_feature (406)..(409): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagacgcacctctgggggcacagcggccctgggctgcctggtcaacggactacttcccgtgtcctgatctgagcgggctggcgaaggcgcatagnnnn

SEQ ID NO: 144664 - DNA, 411 bp, Homo sapiens
  misc_feature: GYAE6OF01AV0K4.5.23.C01.1.454.CMB.1.raw
  modified_base (317)..(317): a, c, t, g, unknown or other
  misc_feature (317)..(317): n is a, c, g, or t
  modified_base (403)..(411): a, c, t, g, unknown or other
  misc_feature (403)..(411): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacgggtcatcgtctcctcagcctccaccaagggcccatcggtcttccccctggcacccctcctccaagngcacctctgggggcacagcggccctgggctgcctggtcaaggactacttccgtgtctgatctgagcgggctggcaaggcgcatagnnnnnnnnn

SEQ ID NO: 144665 - DNA, 456 bp, Homo sapiens
  misc_feature: GYAE6OF01BJ6K4.5.23.C01.1.454.CMB.1.raw
  modified_base (424)..(424): a, c, t, g, unknown or other
  misc_feature (424)..(424): n is a, c, g, or t
  modified_base (430)..(456): a, c, t, g, unknown or other
  misc_feature (430)..(456): n is a, c, g, or t
tcagatcagacacgcacgaccggtgctcgatttagtacacgtgattagggattggggagatctatcattaccggggagcaccaactactaatccgtccctcaagtagtcgagtcaccatatcgtatagacacgtcgaacaaccgagttctccctgaaggtgacctctgtgaccgccgcggacacggccgtctattactgtgccgcggattttcagtagggacaggactactagtatcgacgtctggggcaggagggaccacggtcatcgtctcctcagcctccaccaagggcccatcggtcttcccccctggccacccctcctccaacgaggccgacctccttggggggccacagcggcccctggggcctgcctggtccaaggacctacttcccgtgtctgatctgagcgggctggcaagggcncatagnnnnnnnnnnnnnnnnnnnnnnnnnnn

SEQ ID NO: 144666 - DNA, 410 bp, Homo sapiens
  misc_feature: GYAE6OF01EEY46.5.23.C01.1.454.CMB.1.raw
  modified_base (403)..(410): a, c, t, g, unknown or other
  misc_feature (403)..(410): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggccaccctcctccaagacgcacctctgggggcacagcggccctgggctgcctggtcaaggactacttcccgtgtctgatctgagcggctggcaaggcgcatagnnnnnnnn

SEQ ID NO: 144667 - DNA, 524 bp, Homo sapiens
  misc_feature: GYAE6OF01A1UG4.5.23.C01.1.454.CMB.1.raw
  modified_base (493)..(493): a, c, t, g, unknown or other
  misc_feature (493)..(493): n is a, c, g, or t
  modified_base (514)..(514): a, c, t, g, unknown or other
  misc_feature (514)..(514): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcataccgggagcacaactacaatccgtccctcaagagtcgagtcaccatatctatagacacgtcgaacaaccagttctccctgaacgtgacctctgtcgaccgccgcggacacggccgtctatactgtgcgcggatttcgngacgggacaggactactaatntcgacgtcgg

SEQ ID NO: 144668 - DNA, 535 bp, Homo sapiens
  misc_feature: GYAE6OF01D1769.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaagaggctggagtggattggggagatctatcataccgggagcaccaactacaatccgtccctcaagagtcgagtcaccatatctatagacacgtcgaacaaccagttcctccctgaacgtgacctctgtcgaccgtccgacggacacggccgtctattacgtgtgcgcggtatttcgaggacgggacaggtactacgtatacgtcgacgtcggg

SEQ ID NO: 144669 - DNA, 415 bp, Homo sapiens
  misc_feature: GYAE6OF01C5PNG.5.23.C01.1.454.CMB.1.raw
  modified_base (407)..(415): a, c, t, g, unknown or other
  misc_feature (407)..(415): n is a, c, g, or t
tcagatcagacacgcacgaccggtgctcgatttagtacacgtgattagggattgggaagatctatcataccgggagcaccaactacaatccgtccctcaagagtcgagtcaccatatctatagacacgtcgaacaaccagttctccctgaaggtgacctctgtgaccgcgcggacacggccgtctattactgtgcgcggatttcagagggacaggactactatatcgacgtctggggcagaggaccacggtcatcgtctcctcagcctccaccaagggcccatccggtcttccccctggccaccctcctccaagacgcacctctgggggcacgagcggcctgggctgctggtcaaggactacttcccgtgtctgatcgtgagcgggctgggctaagggcgacatagnnnnnnnnn

SEQ ID NO: 144670 - DNA, 405 bp, Homo sapiens
  misc_feature: GYAE6OF01AHS2J.5.23.C01.1.454.CMB.1.raw
  modified_base (400)..(405): a, c, t, g, unknown or other
  misc_feature (400)..(405): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggccctgggctgcctggtcaaggactactcccgtgtctgatctgagcgggctggcaaggcgcatagnnnnnn

SEQ ID NO: 144671 - DNA, 409 bp, Homo sapiens
  misc_feature: GYAE6OF01APDNW.5.23.C01.1.454.CMB.1.raw
  modified_base (401)..(409): a, c, t, g, unknown or other
  misc_feature (401)..(409): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggccctgggctgcctggtcaaggactacttcccgtgtctgatctgagcgggctggcaaggcgcatagnnnnnnnnn

SEQ ID NO: 144672 - DNA, 403 bp, Homo sapiens
  misc_feature: GYAE6OF01CWV97.5.23.C01.1.454.CMB.1.raw
  modified_base (401)..(403): a, c, t, g, unknown or other
  misc_feature (401)..(403): n is a, c, g, or t
tcagatcagacacgcacgaccggtgctcgatttagtacacgtgattagggattggggagatctatcataccgggagcaccaactacaatccgtccatcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggccctgggctgcctggtcaaggactacttcccgtgtctgatctgagcgggctggcaaggcgcatagnnn

SEQ ID NO: 144673 - DNA, 533 bp, Homo sapiens
  misc_feature: GYAE6OF01E1PNF.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaacgaggctggagtggattggggagatctatcataccgggagcaccaactacaatccgtccctcaagagtcgagtcaccatatctatagacacgtcgaacaaccagttcctccctcgaacggtgacctctgtcgaccgccgcggacacggccgtctattactgtgccggcggtattcgagagggacgaggactactaatactcggacgtcgg

SEQ ID NO: 144674 - DNA, 406 bp, Homo sapiens
  misc_feature: GYAE6OF01BR9TW.5.23.C01.1.454.CMB.1.raw
  modified_base (398)..(406): a, c, t, g, unknown or other
  misc_feature (398)..(406): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaggactactcccggttgatctgagcgggctggcaaggcgcatagnnnnnnnnn

SEQ ID NO: 144675 - DNA, 682 bp, Homo sapiens
  misc_feature: GYAE6OF01CIJCU.5.23.C01.1.454.CMB.1.raw
  modified_base (359)..(359): a, c, t, g, unknown or other
  misc_feature (359)..(359): n is a, c, g, or t
  modified_base (586)..(586): a, c, t, g, unknown or other
  misc_feature (586)..(586): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggacgtcgggcccaggactggtgaacgccgttcgggaccctcgtccctcacctgcgtattgtttcgcgtggctccatcagcctactattaagttggtcggaccgtcggtccgccacgccccgaaggaagcgcgtggagtggtagttgggganattcatacgacgtaccggagaccaacaactacaacgtcccgtaccctagaacgtacgtaccgacgtaccaacctaagttactactaacgtacgaacctaacgtaccgaaacctaccgtaacgttcccgtacccgtaaggtaacgtccgtaccgttcgtacggtccggtaacccggcccggtaccggtaaccgacccgggttacccttaaccgttagtttaacccggnggttacggaccggtcggttaacgtttaccgggaagggtaccgggtaacgtaacgggtaacccttaacgttaagttacgtccggtaacgggttcggg

SEQ ID NO: 144676 - DNA, 537 bp, Homo sapiens
  misc_feature: GYAE6OF01D80JB.5.23.C01.1.454.CMB.1.raw
  modified_base (449)..(449): a, c, t, g, unknown or other
  misc_feature (449)..(449): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttcctcgtggctccatcagcactattaattggtggacctgggtccgccagcccccaggaagaggctggagtgggagttggggagatctatcagtaccgggagcaaccaactacaatccgtccctacaagagtcgagtcaccatactctatagacacgtcaacaacctagtctccctgaacggtnacctctgtcgaccgccgacggaccacggcctactattacgtgtcgcgcggtatttcgaggacggcaggactactatactcgcgtcggg

SEQ ID NO: 144677 - DNA, 536 bp, Homo sapiens
  misc_feature: GYAE6OF01DBQTF.5.23.C01.1.454.CMB.1.raw
  modified_base (528)..(528): a, c, t, g, unknown or other
  misc_feature (528)..(528): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagccccaggaagaggctggagtggattggggagatcgtatcagtaccgggagcaccaactacaaatccgtccctcaagagtcgagtcaaccatatctatagacacgtcgaacaaccagttctccctgaacgtgaacctctcgtcgaccgtccgcggacacggccgtctattactcgtgcgcgtatttcgaggacgggacaggtacctatatatccgngtaccggg

SEQ ID NO: 144678 - DNA, 707 bp, Homo sapiens
  misc_feature: GYAE6OF01D2T1I.5.23.C01.1.454.CMB.1.raw
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggaccctgtccctcaccgtgcgattgtttcgtcgtgcctccatcagctactattaattggtggaccgtgggtccgccgacgaccccgaggaaagnggctgggacgtggagttgggganagtctaacgtcgaacgtaccgggganaccgaaccctaaacgtaacctaacgttaccccggtacccttaacgaacggtaaccggttaccggaacgttacccaaaccgtaattaacttacttaaacgtaacgaaccgtaaccggttaacgaaacctaaccgtacgtttaccctacccgtaggtaacggtaccgtaccgttcgtacgtacccggacccggtccgaccgggaacccgaccggtcccgttacgttacgttaccggtcggtaccggtacgggtccgggttaactttcggaacgggacgggtaacacgggtaacttaacgtaagttacgtacggtccgtacgggg

SEQ ID NO: 144679 - DNA, 426 bp, Homo sapiens
  misc_feature: GYAE6OF01EQM6C.5.23.C01.1.454.CMB.1.raw
  modified_base (416)..(426): a, c, t, g, unknown or other
  misc_feature (416)..(426): n is a, c, g, or t
tcagatcagacacgcacgaccggtgctcgatttagtacacgtgattagggattgggggagatctatcatacccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatccggtcttccccctggccaccctcctccaacgagccaccctcgtcggggggccacgacgcggcccgtgggctggcctggtcaaggactacttcccgtgtctgatctgagcgggctggcaaggcgcatgnnnnnnnnnnn

SEQ ID NO: 144680 - DNA, 559 bp, Homo sapiens
  misc_feature: GYAE6OF01DQWIR.5.23.C01.1.454.CMB.1.raw
  modified_base (367)..(367): a, c, t, g, unknown or other
  misc_feature (367)..(367): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcggcccaggactggtgaagccttcggggaccctgtccctcacctgcgatgttctcgtggctccatcagcactattaattggtggacctgggtccgccacgcccccgaggaaacgaggcgtggagtggagttggggagatctatcagtaccgggancaaccaactacaactccgtccctacaacgagtcgagtcaaccatactactaatagacacgtacgaacaaccctagttacctaccctagaacgtcgacctcgtagtcgaccgccgacggacaccggtccgtactacttactcgtgcggtcggtattcgagacggacacggtactacgtatagtcgacgtacgg

SEQ ID NO: 144681 - DNA, 526 bp, Homo sapiens
  misc_feature: GYAE6OF01BSXK9.5.23.C01.1.454.CMB.1.raw
  modified_base (433)..(433): a, c, t, g, unknown or other
  misc_feature (433)..(433): n is a, c, g, or t
  modified_base (517)..(517): a, c, t, g, unknown or other
  misc_feature (517)..(517): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactataattggtggacctgggtccgccagccccaggaacgaggctggagtggagttggggagatctatcataccgggagcaccaactacaactccgtccctcaacgagtcgagtcaccatactctatagacacgtcgaacaaccagttcnccctgaacggtgacctctgtcgaccgccgcggacacggccgtctatactgtcgcgcggtattcgagacggacaggactactatntcgcgtcgg

SEQ ID NO: 144682 - DNA, 664 bp, Homo sapiens
  misc_feature: GYAE6OF01AI3SF.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaagttggtggacctcgggtccgccgacgcccccgaagggaaacgaggcgtagggacggtgggagttggggacgacgtcgtaacgtcgaacgtaccggggacgaccgaacccgtaaacctaaccgtaaacgttccccgtaccctacgaacgtacgtacgtaacgtaccaaccgtacttaactactaacgtacgaaccgtaaccgtaccgaaacaacccgtacgttacctacccgtaggaacgtacgaccttcgtacggtcgacccggccggaccggaccgtaccgggtccgttacttacgttacgtcggtcggaccggtcggtatttacggaggtacgggacacggtactacgtaagtcgtcggtacggtacggg

SEQ ID NO: 144683 - DNA, 527 bp, Homo sapiens
  misc_feature: GYAE6OF01CWIHI.5.23.C01.1.454.CMB.1.raw
  modified_base (253)..(253): a, c, t, g, unknown or other
  misc_feature (253)..(253): n is a, c, g, or t
  modified_base (441)..(441): a, c, t, g, unknown or other
  misc_feature (441)..(441): n is a, c, g, or t
  modified_base (480)..(480): a, c, t, g, unknown or other
  misc_feature (480)..(480): n is a, c, g, or t
  modified_base (520)..(520): a, c, t, g, unknown or other
  misc_feature (520)..(520): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctnacctgcgatgtttctcgtggctccatcagcactattaattggtggacctgggtccgccagcccccaggaaagagctggagtggattggggagatctatcataccgggagcaccaactacaaatccgtcctcaagagtcgagtcaccatatctatagacacgtacgaacaaccagtctccctgaaggtnaacctctgtgaccgccgcggacacggccgtctattaccngtgcgcggatttcgagagggacagggactacgtatatcgngttacgg

SEQ ID NO: 144684 - DNA, 587 bp, Homo sapiens
  misc_feature: GYAE6OF01DHJ2K.5.23.C01.1.454.CMB.1.raw
  modified_base (523)..(523): a, c, t, g, unknown or other
  misc_feature (523)..(523): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcaccgtgcgattgttctcgtggctccatcagcactattaatggtgacctggtccgccacgccccgaaggaaagagctggacgtggagttggggagtagtctagtcagtaccgggagaccaaccaaacttacaaactccgtaccctacaagacgtcgagtacacgtatatctaatagactaacgtacgaaaccaacctagttcctacccgtagaacggtcacgtcgtacgtcggacccgtccgaccggaccacggtaccgtcttattaccgngtcgcggtcgtattacgaggtacggaaccgtaggtaacctacttaacgctacgcggttaccggg

SEQ ID NO: 144685 - DNA, 552 bp, Homo sapiens
  misc_feature: GYAE6OF01BROBB.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggtccaggactggtgaagccttcggggaccctgtccctcacctgcgatgtttctcgtggctccatcagcactattaattggtggacctgggtccgccacgcccccaggaaacgaggcgtggacgtggagttggggagatcgtatcaagtaccgggagacaaccgaactacaactccgtacctacaagatcgagtacaccatactctaatagacacgtacgaacaccagttcctacctgaagtcgactctcgtcgaccgccgcggacaccggcctctatactgtcgcgcggtattcgaggacggacgaaggtacctaactatacgtcggacgttacggg

SEQ ID NO: 144686 - DNA, 412 bp, Homo sapiens
  misc_feature: GYAE6OF01BHFKE.5.23.C01.1.454.CMB.1.raw
  modified_base (404)..(412): a, c, t, g, unknown or other
  misc_feature (404)..(412): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggccctgggctgcctggtcaaggactacttcccgtgtctgatctgacgcgggctggcaagggcgcgatagnnnnnnnnn

SEQ ID NO: 144687 - DNA, 750 bp, Homo sapiens
  misc_feature: GYAE6OF01C59OJ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggaccctgtccctcacctgcgatgtttctcgtcggctccatcagctactattaattcggtgaccgtcgggtccgcctacggcccccgaagggaaacggacggcgtcgggaggtacgggtagttggggaagtacgttcgtaagtacgaacgttaaccggggaacgaccgaacccgtaaacctaaccgtaaaccttccccgtaccctacgaaacggtacgtaccggtaacgtaccgaacctattaacgttacttaagtaacgaaccgtaaccgtaaccgaaacctaaacccgtaacgttacccttacccgttaacggtaacgggttccgtacccgttccgttacggtaccggaacccggtcccgggaccgggtaaccgaacccgggtcccgttacgttaacgttaccgttcggtacggtccggtacgggttaactttacggaacgggtaaccgggtaacgtaacgggtaaccttaaccgttaagttaacgtaccgggtacggttaccgggg

SEQ ID NO: 144688 - DNA, 581 bp, Homo sapiens
  misc_feature: GYAE6OF01AD1KP.5.23.C01.1.454.CMB.1.raw
tcagatcagacacgcacgaccggtgctcgatttagtacacgtgattagggattgggcacgaccggtgctcgatttagtacacgtgattagggattggggatactttctgatactcatggacctcctgcacaagaacatgaaacacctgtggttcctcctcctcctggtggcagctcccagatgggccctgtctcaggtgcagctgcaggagtcgggcccaggactggtgaagccgttcggggaccctggtccctcacctgcgatgtttctcgtggctccatcagcactattaattggtggacctggtccgccacgcccccaggaaacgaggctggagtggacgttggggagatctatcagtaccgggagacaaccaactacaatcccgtccctacaagacgtcgacgtcaaccatactctaatagacacgtaccgaactaaccacgttacctacccgtagaacggtcgaacccgtctacggtcgacccgcccgacggacacccggccgtactacttcgtacgtcggaccgtcggtatttcgaggacgggacaacgggacttacgatacgtcgaacgtcggg

SEQ ID NO: 144689 - DNA, 407 bp, Homo sapiens
  misc_feature: GYAE6OF01BTXZL.5.23.C01.1.454.CMB.1.raw
  modified_base (402)..(407): a, c, t, g, unknown or other
  misc_feature (402)..(407): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctcaccaagggcccatcggtcttccccctggcacccctcctccaagagcacctctgggggcacagcggccctgggctgcctggtcaaggactacttcccgtgtctgatctgagcgggctggcaaggcgcatagnnnnnn

SEQ ID NO: 144690 - DNA, 561 bp, Homo sapiens
  misc_feature: GYAE6OF01CFBVA.5.23.C01.1.454.CMB.1.raw
  modified_base (283)..(283): a, c, t, g, unknown or other
  misc_feature (283)..(283): n is a, c, g, or t
  modified_base (330)..(330): a, c, t, g, unknown or other
  misc_feature (330)..(330): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactggtgaagccgttcggggaccctgtccctcacctgcgatgtttctcgtggctccatcngcactattaattggtggacctgggtccgccacgcccccaggaaacgnggctggagtggagttggggagagtctagtcaagtaccgggagcaaccaactacaactcccgtaccctacaagacgtcgacgtacacatactctatagaacacgtacaacaaccacgttcctcctagaggtcacctctgtacgaccgtccgcggacgaccggcctctacttactcgtgcgcgtagtactttcgaggtaggacgtacggactaagtaactagtcggtaaccgg

SEQ ID NO: 144691 - DNA, 586 bp, Homo sapiens
  misc_feature: GYAE6OF01A6SEK.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctggtggcagctcccagatgggccctgtctcaggtgcagctgcaggagtcgggcccaggactggtgaacgccgttcggggaccctgtccctcacctgcgatgtttcgtcgtggctccatcagcactattaagttggtggtaccgtgggtccgcctacgcccccgaggaaacgacggcgtggaggtggtagttggggagagtctagtcgagtaccggagacaacaactacaactccgtcctacgaagacgtacgacgtacacctatactactatacgacacgtacgaacaaccgtacgtcctacctaggaacgtcgacctcgtcgtcgacccggccgtacgacgtacggccgtactacttacgtgtcgcggtcgtactttacgacggtacggacgacggtactactagtactcggtcgtcgtacggg

SEQ ID NO: 144692 - DNA, 561 bp, Homo sapiens
  misc_feature: GYAE6OF01DQDTJ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaagaggctgggagtggagttggggagagtctatcagtaccgggagcaccaactacaactccgtaccctacgaagacgtcgacgtcaaccatactctatacgacacgtacgaactaaccacgttctacccgtgaacgtgacctctgtcgaccgccgcggacaccggccgtctacttactggtgccggcggtatttcgacggacgggacaacgggtactaacgtatacgtcgacgttacggg

SEQ ID NO: 144693 - DNA, 406 bp, Homo sapiens
  misc_feature: GYAE6OF01E4FP5.5.23.C01.1.454.CMB.1.raw
  modified_base (402)..(406): a, c, t, g, unknown or other
  misc_feature (402)..(406): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctcgtgggggcacagcggccctgggctgcctggtcaaggactacttcccgtgtctgatctgagcggctggcaaggcgcatagnnnnn

SEQ ID NO: 144694 - DNA, 957 bp, Homo sapiens
  misc_feature: GYAE6OF01CW1Z1.5.23.C01.1.454.CMB.1.raw
  modified_base (254)..(254): a, c, t, g, unknown or other
  misc_feature (254)..(254): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggccaggactggtgaacgtccgttcgggaccctgtccctntacctgcgactgtttctcgtcggctccactcacgctacttattaagttgggtcggtaccgtcgggtcccgtcccgacggtacccccgaagggaaaacggacgggacctagggtacggtagggtaacggtttgggggaacgtacgttacgttaacgttacgaacggttaacccggggaacgtaccggtaaaccctaaaaccgtaaccgtaaaccgttcccccgttaaccccgttaaccgaaacggtaccggttaaccggtaacggtacccgtaaacccgtaaacgtttaacttaacccgtttaacgttaaacggtaaacccgtaacccggttaacccgtaaaacccgtaaaccccgttaacgtttaccccgtttaaccccggttaacgggtaaaccgggtttaccgggtaaccccgtttaaccggttacccgggttaaccgggtaaccccgggtaccccgggtaacccgggtaaaccccggttaacccggggttaccccggtttaaccgtttaaaccgttttaacccgggttaccgggttacgggtcccggggttaaaccggggttaaccgttttttacccggggaaaacgggttaaacccgggggggttaaacccctaaaccgggggtttaaaccctttaaaaccggttaaccgttttaaaaccgggtttcccgggttaaacccggggttttaaacccggggg

SEQ ID NO: 144695 - DNA, 527 bp, Homo sapiens
  misc_feature: GYAE6OF01DEGHI.5.23.C01.1.454.CMB.1.raw
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (481)..(481): a, c, t, g, unknown or other
  misc_feature (481)..(481): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtgacctgggtccgccagccccaggaagaggctggagtggattgggganatctatcataccgggancaccaactacaaatccgtacctcaagagtcgagtcaccatatctatagacacgtacgaacaacccagtctccctgaaggtcgacctctggtgacccgccgcggacacggccgtctattacngtgcgcgtatttcagagggacaggactaacgtatactcgacgtcgg

SEQ ID NO: 144696 - DNA, 576 bp, Homo sapiens
  misc_feature: GYAE6OF01BDBPD.5.23.C01.1.454.CMB.1.raw
  modified_base (330)..(330): a, c, t, g, unknown or other
  misc_feature (330)..(330): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactggtgaacgccgttcggggaccctgtccctcacctgcgatgtttctcgtggctccatcagcactattaattggtggacctgggtccgccacgccccaggaaacgnggctggagtggagttggggagatctatcgagtaccgggagcaaccaactacaactcccgtaccctacgaacgacgtcgacgtccacctatactactagtagacacgtacgaaacaccagttcctccctaggaacgtcgacctcgtacgtcgaccgccgacggacaccggccgtctattaccgtggtcgccggcggtatttcggaggacgggacacggtaacctactaatactcggtacgtccgggg

SEQ ID NO: 144697 - DNA, 568 bp, Homo sapiens
  misc_feature: GYAE6OF01D18YK.5.23.C01.1.454.CMB.1.raw
  modified_base (313)..(313): a, c, t, g, unknown or other
  misc_feature (313)..(313): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttccggggaccctgtccctcacctgcgatgtttctcgtggctccatcagcactattaattggtggacctggggtccnccacgcccccaggaaagaggctaggagtgggagttggggagagtctatcacgtaccgggagaccaaccaactacaactcccgtccctacgaagacgtcgacgtaccaccatactctatacgacacgtcgaacaacctagttcctccctagaaggtcgacctctcgtacgacccgccgaccggaccgaccggcctactattacgtgtcgcggcgtatttcgaggacggacgacggtctaactatactcgcggtcgg

SEQ ID NO: 144698 - DNA, 564 bp, Homo sapiens
  misc_feature: GYAE6OF01BU7PS.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgccgatgtttctcgtggctccatcagcactattaattggtggacctgggtccgccagcccccaggaaagaggcgtggagtggagttggggagatcgtatcgagtaccgggagcaaccaactacaactccgtaccctacgaagacgtcgacgtccaacctatatctatacgacacgtacgaacaaccagttcctccctgaacggtcacctctagtcgaccgccgcggactaccgggccgtactagttacgtcgtgccgtcggtatttcgacggacgggacacggtactactatacgtcgacgtccggg

SEQ ID NO: 144699 - DNA, 537 bp, Homo sapiens
  misc_feature: GYAE6OF01DT3FO.5.23.C01.1.454.CMB.1.raw
  modified_base (364)..(364): a, c, t, g, unknown or other
  misc_feature (364)..(364): n is a, c, g, or t
  modified_base (396)..(396): a, c, t, g, unknown or other
  misc_feature (396)..(396): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (473)..(473): a, c, t, g, unknown or other
  misc_feature (473)..(473): n is a, c, g, or t
  modified_base (488)..(488): a, c, t, g, unknown or other
  misc_feature (488)..(488): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgcccagccccaggaagaggctggagtggagttggggagatctatcagtaccggganccgaaccaactacaatcccgtaccctcaaagngtcgacgtcaaccatatctatagacacgtcgaacaacctagtctccctgaaggtnacctctgngacccgccgcgacnccggccgtctattcngtgcgtcggatttcgaggacgggacaggacttactataactcgcgtcgg

SEQ ID NO: 144700 - DNA, 426 bp, Homo sapiens
  misc_feature: GYAE6OF01CSHAH.5.23.C01.1.454.CMB.1.raw
  modified_base (417)..(426): a, c, t, g, unknown or other
  misc_feature (417)..(426): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccgtggccaccctcctccaagacgccaccctcgtcgggggcacgagccggccctgggctcgcctggtcaacggactacgttcccgtgtctgatcgtgagcggctggcaagggcgacgatagnnnnnnnnnn

SEQ ID NO: 144701 - DNA, 541 bp, Homo sapiens
  misc_feature: GYAE6OF01AKPLB.5.23.C01.1.454.CMB.1.raw
  modified_base (438)..(438): a, c, t, g, unknown or other
  misc_feature (438)..(438): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggcctgggagtggattggggacgatcgtatcgataccgggagcaccaactacaatcccgtccctcaagagtcgagtcaccatactctatagacacgtcaacaaccacgttcnccctgagtgacctctcgtgaccgccggccggacaccggccgtctacttacgtgtcgcgcggtatttcgaggacgggacaggtacctatatatcggacgtcggg

SEQ ID NO: 144702 - DNA, 411 bp, Homo sapiens
  misc_feature: GYAE6OF01DF9S8.5.23.C01.1.454.CMB.1.raw
  modified_base (405)..(411): a, c, t, g, unknown or other
  misc_feature (405)..(411): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaaggcccatcggtcttccccctggccaccctcctccaagagtacctcgtgggggcacagccggccctgggctgcctggtcaaggactacgttcccgtgtctgatctgagcgggctggcaggcgacatagnnnnnnn

SEQ ID NO: 144703 - DNA, 611 bp, Homo sapiens
  misc_feature: GYAE6OF01D6692.5.23.C01.1.454.CMB.1.raw
  modified_base (330)..(330): a, c, t, g, unknown or other
  misc_feature (330)..(330): n is a, c, g, or t
  modified_base (374)..(374): a, c, t, g, unknown or other
  misc_feature (374)..(374): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcgggaccctgtccctcacctgcgatgttctcgtggctccatcagcactattaattggtcgaccgtgggtccgccgacgccccgaaggaacgnggcgtggagtgggagttggggatatcgtatcgacgtaccggganaccaaccaactaaccactacccgtaccctacgaagcgtacgacgtacaacctatactactagaagactaccgtacgaaacctaacctacgttcctacccgtaggaacggtcgaccgttcgtagttaccgacccggtcccgaccggaccgaccggtccgttactacgttacgtgtacggacggtcgttagtttacgaacggacgggacgacggtacctaatatacgtcggcgtacggg

SEQ ID NO: 144704 - DNA, 415 bp, Homo sapiens
  misc_feature: GYAE6OF01DC3Y0.5.23.C01.1.454.CMB.1.raw
  modified_base (407)..(415): a, c, t, g, unknown or other
  misc_feature (407)..(415): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccaggtcatcgtctcctcagcctccaccaagggcccatcggtccttccccctggccaccctcctccaagagcacctcgtgggggcacgagcggcccgtggctcgcctggtcaaggacttacttcccgtgtctgatctgagcgggctggcaaggcgcatagnnnnnnnnn

SEQ ID NO: 144705 - DNA, 781 bp, Homo sapiens
  misc_feature: GYAE6OF01AFBHF.5.23.C01.1.454.CMB.1.raw
  modified_base (326)..(326): a, c, t, g, unknown or other
  misc_feature (326)..(326): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcgaggagtcgggcccaggactggtgacgccgttccgggaccctcgtccctcaccgtgcgagttcgtttcgtcgtcggcctccatcagcctactaattaagttggtcggaccgtcgggtccnccgacgtacccccgaagggaaacgacggtccgtagggtaggttagggagttagggggagtacgtcgtaagtaccgaacggttacccggggaacgaccgtaaccaaacgtaccgtaacgtccccggttacccgtaacgaacgtacgtaccggtacgtaccgtaacctagttacttaccgttaacgtaaccgtaacgtaaccggtaccgaaacctaacccgtaccgtttacccgtaccccgttagggtaacggttaccggtacccgttcgttaccgggttacccggaccccgggtacccgggacccgggtaacccggtaaccgggtccccgttaccgtttaacgttaccgttaccgggtaccggtccgggtaaccgggttacgtttaccggaacggggtacgggaaaccgtacggtaacttaacgttaagtacgttacccgggtagttacccggggg

SEQ ID NO: 144706 - DNA, 537 bp, Homo sapiens
  misc_feature: GYAE6OF01B1878.5.23.C01.1.454.CMB.1.raw
  modified_base (325)..(325): a, c, t, g, unknown or other
  misc_feature (325)..(325): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaatggtggacctggtccgccagcccccaggaaacgnggcgtggagtggagttggggagatctatcagtaccgggagcaccaactacaactccgtccctcaagagtcgacgtacaccatatactatagacacgtcgaaccaacacgttcctccctagaacgtcgacctctgtcgaccgccgcggacacggcctctattactgtgcgcggtattcgaggacggacaggtactactatacgtcgcgtcggg

SEQ ID NO: 144707 - DNA, 676 bp, Homo sapiens
  misc_feature: GYAE6OF01BNSHB.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcgggaccctgtccctcaccgtgcgtatcgtttctcggtggcctccatcagcacttattaagttggtcggaccgtggggtcccgcccgacggacccccgaagggaaacgacgggcgtagggaggttgggtagttgggggagtagtctatacgacgtaccggggagccgaaccgtaactaacaacgtcccgtaccctacgaacgacgtaccgacgtaccacctatactactaagtacgacctaccgtaccgaaactaaccgtacgttacctacccgtaggtaacggtcgtacccgttcgtacggtaccggacccggtacccggaccggaccgtaccgggcccgttacgttacgttacgtcggtacggtcggtccggtatttacggacgggtaacggaccgacgggttacctacgttagtacgtccggtacggttccgggg

SEQ ID NO: 144708 - DNA, 423 bp, Homo sapiens
  misc_feature: GYAE6OF01D4T72.5.23.C01.1.454.CMB.1.raw
  modified_base (415)..(423): a, c, t, g, unknown or other
  misc_feature (415)..(423): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcaggagggaccacggtcatcgtctcctcagcctccaccaagggcccatcggtcttccccctggccaccctcctccaagacgccacctcgtcgggggcacagccgcccgtgggctcgcctggtcaaggtactacgttcccgtgtctgatctggagcggctggcaagggcgacagtagnnnnnnnnn

SEQ ID NO: 144709 - DNA, 595 bp, Homo sapiens
  misc_feature: GYAE6OF01E1IHY.5.23.C01.1.454.CMB.1.raw
  modified_base (324)..(324): a, c, t, g, unknown or other
  misc_feature (324)..(324): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcgggaccctgtccctcacctgcgatgttctcgtggctccatcagcactattaatggtggacctgggtccgccacgccccaggaagnggcgtggagtggagttggggagactcgtatcagtaccgggacacaccaactacaacgtcccgtacctacgaacgacgtcgacgtaccacatactactatacgactaacgtaccaacaacctagttccctacctacggaacgtcgacctctcgtacggacccgtccggaccgacgacccggtcgtaccgttacttacgtcgtcggtacggcggttatttaccggaggtacgggaacgacggtactactagtacgtccggtacggttaccggg

SEQ ID NO: 144710 - DNA, 536 bp, Homo sapiens
  misc_feature: GYAE6OF01EAHEV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggacctgggtccgccagcccccgaggaaagaggctggagtgggattggggagatctatcataccgggagcaccaactacaatcccgtcctacaagagtcgagtccaaccatatactataacgacacgtacgaacaaccagttcctaccctgaacggtcacctctgtcgaccgccgcgacacggccgtctattcgtgtgcgcggattcgagagggacaggactactatactcgcgtcggg

SEQ ID NO: 144711 - DNA, 409 bp, Homo sapiens
  misc_feature: GYAE6OF01C7JIW.5.23.C01.1.454.CMB.1.raw
  modified_base (403)..(409): a, c, t, g, unknown or other
  misc_feature (403)..(409): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctacctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggccaccctcctccaagacgcacctctgggggcacagcggccctgggctgcctggtcaaggactacttcccgtgtctgatctgagcggctggcaaggcgcatagnnnnnnn

SEQ ID NO: 144712 - DNA, 412 bp, Homo sapiens
  misc_feature: GYAE6OF01EG5EL.5.23.C01.1.454.CMB.1.raw
  modified_base (404)..(412): a, c, t, g, unknown or other
  misc_feature (404)..(412): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggccaccctcctccagacgccacctcgtgggggcacgagcggccctgggctgcctggcaaggactacttcccgtgtctgatctgagcggctggcaggcgcagtagnnnnnnnnn

SEQ ID NO: 144713 - DNA, 553 bp, Homo sapiens
  misc_feature: GYAE6OF01A8OOX.5.23.C01.1.454.CMB.1.raw
  modified_base (326)..(326): a, c, t, g, unknown or other
  misc_feature (326)..(326): n is a, c, g, or t
  modified_base (353)..(353): a, c, t, g, unknown or other
  misc_feature (353)..(353): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaatggtggacctgggtccgccagcccccaggaaacgnggctgggagtggagttggggagacgtntatcaagtaccgggagcaaccaactacaactccgtccctcgaagagtcgagtcaccatactctatacgacacgtacaacaacctacgttactccctagaacgtcgacctctgtcgacccgccgacggaccgacggccgtctacttacgtgtcgcgcggtatttcgagacgggacagggtacctactatactcgacgtcgg

SEQ ID NO: 144714 - DNA, 686 bp, Homo sapiens
  misc_feature: GYAE6OF01CA26P.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgtaggagtccgggcccaggctggtagaagccgttcggggaccctgtccctcacctgcgattgtttctcgtggctccatcagcactacttaagttggtcggaccgttgggtcccgccgtacgccccccgaagggaaaggacggccgtagggaggtcggtagttcggggagagttacgtagtacgaacgtaccgggtagacaacccaaacgtaccaatcccgtaccctacaaggacgttacgaacgtaccaacacgttaactctaagtacgaaccacgtacgaaccaaacctacgttacctacccgttagtaacggtgtaaccctgtacgtaccgacccggcccggtaccggaacgtacccgggtaccgttacgtaccgttactcggtcggtacggaccggttcgttttaccgaacgggtacgggaaccgtacggtaacctaaccgttaacttaagtcccgtaacggtccggttaaccgggggg

SEQ ID NO: 144715 - DNA, 574 bp, Homo sapiens
  misc_feature: GYAE6OF01DYJO2.5.23.C01.1.454.CMB.1.raw
  modified_base (369)..(369): a, c, t, g, unknown or other
  misc_feature (369)..(369): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcaccgtgcgatgtttctcgtggctccatcagcactattaattggtggacctgggtccgccacgcccccaggaacgaggctggagtggagttggggagatctatcgagtaccggganacaccaactacaaactcccgtaccctcaagngtacgatccaaccatactctanagacacgtaccgaacaacctacgttcctacccgtgaagtcgacctcgtacgtcgacccgccggaccggacaccggtcccgtacttactcgttaggtgaccgtcggtatttcgaggacgggactaggactaacgtatactcggaacgtccggg

SEQ ID NO: 144716 - DNA, 419 bp, Homo sapiens
  misc_feature: GYAE6OF01D9B81.5.23.C01.1.454.CMB.1.raw
  modified_base (410)..(419): a, c, t, g, unknown or other
  misc_feature (410)..(419): n is a, c, g, or t
tcagatcagacacgcacgaccggtgctcgatttagtacacgtgattagggattgggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtcgtggggcaggagggaccacggtcatcgtctcctcagcctccaccaaggcccatcggtcttccccctggccaccctcctccaagagcacctcgtgggggcacacgcggccctgggctgcctggtcaaggactacttcccgtgtctgatctgaggcggcgtggcgaaggcgcagtagnnnnnnnnnn

SEQ ID NO: 144717 - DNA, 601 bp, Homo sapiens
  misc_feature: GYAE6OF01BM88W.5.23.C01.1.454.CMB.1.raw
  modified_base (492)..(492): a, c, t, g, unknown or other
  misc_feature (492)..(492): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccgagatgggccctggtctcaggtgcagctgcaggagtccgggccaggactggtagacgtccgttccgggaccctcgtccctacacctgcgagtcgtttctcgtcggctccgatcagcactattaacgttggtggaccgtgggtccgccgtacgaccccgaggaaaggaggcgtagggagtggagttggggagtactcgtatcgacgtacgggagaccaaccaactaacactccgtccctacgaagacgtcgacgtacaccaatactactaatacgaacacgtacaaactaaccacgtttccaccctagacgtacnccgttctcgtacgccgtccggacggaccaccggaccgtactactacgttgcgtccgcggttattacggagacgggaacacggtactacgttatacgtcgtcggtacggg

SEQ ID NO: 144718 - DNA, 608 bp, Homo sapiens
  misc_feature: GYAE6OF01BKWDU.5.23.C01.1.454.CMB.1.raw
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgttctcgtggctccatcagcactattaattggtggaccgtggtccgccacgcccccaaggaaagnggcgtggagtggagtggggatatctatcagtaccgggancaccaactacaactccgtccctacaagacgtcgacgtaccaactatactactaatacgaaccacgtaccgaaaccaaccctacgttacctcccgtaggaacggtacgaccttcctgtaccgacccggtccggaccggtaaccgaccgggtacccgttacttagttaccgtgtcggaccgtcggtatttaccggaggacgggtaacacgggtacctacgtaatacgtccgtacggtaccggg

SEQ ID NO: 144719 - DNA, 412 bp, Homo sapiens
  misc_feature: GYAE6OF01A13A7.5.23.C01.1.454.CMB.1.raw
  modified_base (403)..(412): a, c, t, g, unknown or other
  misc_feature (403)..(412): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccttgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagacgcacctctgggggcacagcggccctgggctgcctggtcaaggactacttcccgtgtctgatctgagcgggctggcaaggcgcatagnnnnnnnnnn

SEQ ID NO: 144720 - DNA, 848 bp, Homo sapiens
  misc_feature: GYAE6OF01B5G59.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggacgtcgggcccaggacgtggtagaacgtccgttcggggaccctcggtccctcacctgcgtattcgtttctcgtcggcctccatcagctactatttaagttggtcggaccgtcgggtcccgtcccgaccggacccccgtaagggaaaacggacgggccgttaggggacggttagggtaacggtttagggggaacgtaacgttccgttaacgtaccggaaacggttaacccgggggaacgtaacccgaaacccgtaaaaccgttaaacccgaaaccgtttacccccggttaaccccttaaccggaaaacggtaacgggttaacccggaacggttacccctaaaccccgtaagtttaaccttaaccgttaaacgtaaccgaaacccgtaaccgggttaaacccgaaacccgtaaacccgttacggtttaccctaaccccgtacggtaacgggttaccgtaacccgtttccgtacggttacccggaacccccggtacccggaacccgggaccgtaacccgggttcccgttaacgttaccgtttaccgtcggtacggaccggtaccgggttacgtttaccggaacgggtaacgggtaacctacgggtaaccttaacgtagttacgtaccggacggttaccgggg

SEQ ID NO: 144721 - DNA, 570 bp, Homo sapiens
  misc_feature: GYAE6OF01BTQRU.5.23.C01.1.454.CMB.1.raw
  modified_base (312)..(312): a, c, t, g, unknown or other
  misc_feature (312)..(312): n is a, c, g, or t
  modified_base (398)..(398): a, c, t, g, unknown or other
  misc_feature (398)..(398): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgcccgttcggggaccctgtccctcacctgcgtattttctcgtggctccatcagcactattaattggtggacctgggtccnccgacgccccgaggaacgcggcgtggacgtggagttggggagagtctatcgacgtaccggagccaaccaactacactcccgtcccnaagacgtcgacgtcacctatatctatacgacacgtacaaccacctagttcctccgtagacggtcacctctcgtcgaccgccggaccggacgaccggccgtactacttacgtgtcggcggtcggtatttacgaggtcggacaggacctactagtatcgtacgtcggtacgggg

SEQ ID NO: 144722 - DNA, 648 bp, Homo sapiens
  misc_feature: GYAE6OF01CZD3F.5.23.C01.1.454.CMB.1.raw
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggaccctggtccctcacctgccgatcgtttctcgtggctccatcagcactattaattggtgacctggtccnccacgccccaggaagnggctgggagtggagttggganacgtntatcagtaccggagcacaactacatccgtcctanaagagtcgagtcaccatactctatagacacgtacgaacaacctacgtactcccgtagaacggtcgaaccttcgtacgtaccggacccggacccggtaccgggaaccctacccggggtaccgttaccgttacgtttaaccgtcgggttaccggccgggtaccgggttaagttttacccggaaagggtaaccgggggtaacccaacgggggtaaacccttaaccgttaaataaccggttccgggtaaccgggttacccgggg

SEQ ID NO: 144723 - DNA, 408 bp, Homo sapiens
  misc_feature: GYAE6OF01CDUMB.5.23.C01.1.454.CMB.1.raw
  modified_base (400)..(408): a, c, t, g, unknown or other
  misc_feature (400)..(408): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggctacttcccgtgtctgatctgagcggctggcaaggcgcatagnnnnnnnnn

SEQ ID NO: 144724 - DNA, 687 bp, Homo sapiens
  misc_feature: GYAE6OF01CWWRY.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcacgcactattaagttggtcggaccgtgggtccgccgacgcccccgaaggaaacgacggctagggagtgggacgttggggaagatctagtcgagtacccggggagacaacctaaaccgtacaaacttcccgtaccctacaaacgtacgtcgtaacgtacccaaccgtaataactacttaataacgtaccaaccgtaccgaaacctaaaccctaacgttcctacccgttaggaacggttacgaaccttccgtacggtacggtaccccggccggaccggaccgtaccgggtcccgtaccgttacgttaaccgtcggttacggtccgtaccgggtattttaaccggacgggaacgggtaacccgaagggtaaccttaaacgtagttaaccgtccggtaacggttaccggg

SEQ ID NO: 144725 - DNA, 420 bp, Homo sapiens
  misc_feature: GYAE6OF01BBDSK.5.23.C01.1.454.CMB.1.raw
  modified_base (411)..(420): a, c, t, g, unknown or other
  misc_feature (411)..(420): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggccacccctcctccaagacgccaccctcgtcgggggcacgagccggcccgtggctgccgtggtcaaggactacgttcccgtgtctgatctgacgcggctggcaggcgcatgnnnnnnnnnn

SEQ ID NO: 144726 - DNA, 590 bp, Homo sapiens
  misc_feature: GYAE6OF01AIIYD.5.23.C01.1.454.CMB.1.raw
  modified_base (332)..(332): a, c, t, g, unknown or other
  misc_feature (332)..(332): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactgggtgaagccgttccgggggaccctgtccctcaactgcgatgtttctcgtggctccatcagcactattaattggtggacctggtccgccacgcccccgaggaaacgnggctggagtggagttggggagatctactcacgtaccgggacgccaaccaactaccaactcccgtaccctacaagacgtacgtacgtccaactactatactaataacgactacgtaccgaaacaaccagttacctccgtagaacggtcgactcgtcgcgaccgccgacgacgccggtaccgtctacgttcgtcgtcgcggtcggtatttcggaacgacgggaactaacggtacctacgtaatacgtcgtcggttacggg

SEQ ID NO: 144727 - DNA, 671 bp, Homo sapiens
  misc_feature: GYAE6OF01AKS1V.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggacgtcgggcccgaggacgtggtgaacgccgttccggggaccctcgtccctcacctgcgtatgtttctcgtcggctccatcagctactattaagttggtcggaccgtgggtcccgccgaccggacccccgaagggaaacggacgggtcgtagggaggtgggtacggttgggggagtacgtctagtacgaacggtaccgggagaccaaccaactaacctaacgttcccgtaccctacgtaacgacggtcgtacgtaccaacctataactactaactacgaacctaacgtaccgaaacctaaccgtacgttacctacccgtagtaacgttccgtacctcgtacggtaccggacccggccggaccggaccgaccggtccgttacttacgttcgtcggtcggccggtacggtatttacggaggtacgggactacggtaactacgtaagtactccgggtcgttacggg

SEQ ID NO: 144728 - DNA, 730 bp, Homo sapiens
  misc_feature: GYAE6OF01ELRWC.5.23.C01.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtgttcctcctcctcctggtggcagctccagatgggccctgtctcaggtncagctgcaggagtcgggcccagggactgggtgaacgtccgttacggggaccctggttccctcaccgtgcgtattcgtttcgtcgtcggcttaccatccgagtcctaacttatttaaagttgggtacggtaccgttcggggtccccgaccgaccggacccccgtaagggaaacggacgggtcgtagggtaaggttcgggtaggtttgggggaactacgtacgttaataccgaaggttaaccggggacgacctaacccgaaacgtaccgtaaactttaccccggaccctaacgaacggaacgtcgaccgtaccaacctaattactactaagtaacgaccgtaacgtaccgaaacctaaccgtacgtttaccctccgtaagtaacggtaccgtaccctcggtacgtaccggacccgtacccgacggtaaccgtccgtacccggttctaacgttaccgttcgtacggtacggtcgttaagtttccgaagggtacggtacgacggtaactacgtaagtacgtccggtacgttacgggg

SEQ ID NO: 144729 - DNA, 458 bp, Homo sapiens
  misc_feature: GYAE6OF01EWG5Q.5.23.C01.1.454.CMB.1.raw
  modified_base (299)..(299): a, c, t, g, unknown or other
  misc_feature (299)..(299): n is a, c, g, or t
  modified_base (315)..(315): a, c, t, g, unknown or other
  misc_feature (315)..(315): n is a, c, g, or t
  modified_base (441)..(458): a, c, t, g, unknown or other
  misc_feature (441)..(458): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctatactgtgcgcggatttcagaagggacaggactactatatcgacgtcgtggggcagagggaccacggtcatcgtctcctcagccctccaccagggcccatcggtcttcccccnggccaccctcctaccngggagcaccctcgtgggggcacgacgccgggccccgtcgggcgtcgacccgttcggtacgaacggacttacccgtttccccggtgttcctgaatcgtgacggcgggcgtggacaaggcacagtagnnnnnnnnnnnnnnnnnn

SEQ ID NO: 144730 - DNA, 585 bp, Homo sapiens
  misc_feature: GYAE6OF01DJZ6K.5.23.C01.1.454.CMB.1.raw
  modified_base (406)..(406): a, c, t, g, unknown or other
  misc_feature (406)..(406): n is a, c, g, or t
  modified_base (467)..(467): a, c, t, g, unknown or other
  misc_feature (467)..(467): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaaccatgaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaatggtggacctggtccgccagccccaggaaacgagctggacgtggattggggagatctatcataccgggagcaccaactacaatccgtaccctcaagagtacgagtcaaccataanctataagacacgtacgaacaacccagttctaccctgaacggtcacctctcgtacggtaccncccggcgacaaccggccgttctaacttaccgtagtttcggacgtccgggtaattttcgaaacggaacggggacaaacgggaccttaaacgtaattaaccgtcggtacggttacccggg

SEQ ID NO: 144731 - DNA, 757 bp, Homo sapiens
  misc_feature: GYAE6OF01BMU18.5.23.C01.1.454.CMB.1.raw
  modified_base (144)..(144): a, c, t, g, unknown or other
  misc_feature (144)..(144): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacncctgtgttcctcctcctccgtggtgcagctccagagtcgggccctgtctcgaggtgcagctaggcgagggacggtccggggcccgagggacgttgggtacgaacgtcccggttccggggaccccttcgtacccgtccgtaccgtcggtacggtacgtttcggttttccgtaccggtcggtcctaccacgttacgacgtacctaacgttaagtttaaagtcgggtacggtaccgttccggggtacccgaccgaaccggtaccccgaagggaaaggcggtacgtagggacgtggtaggtcggggactgtacgtagtacgaacggtacccgggaagaccaacctaaaccgtactaaccgttccgtacccagaacgtacggtcgtacgtaccactaacgtactaccgtaagtaacgtaaccaacggtaacctaaacgtaaccgtaccgtttaccgtacccgtagtaacggtccgtaaccgttcgtacggttaccgacccgtccgggaaccgtccgaccggtaccttacgttacgtacgttcggcgtaccggtaccgttagtacggaaggaccggtacgaacgttaacctaacgttagtacgtccgggacggtacggg

SEQ ID NO: 144732 - DNA, 798 bp, Homo sapiens
  misc_feature: GYAE6OF01D4QY8.5.23.C01.1.454.CMB.1.raw
  modified_base (237)..(237): a, c, t, g, unknown or other
  misc_feature (237)..(237): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttccctcctcctcctggtggcagcctcccagacgtcgggccctgtctcgaggtgcagctgcagggagtccgggcccaggacgtggngaacgtcccgttccggggaccctcgtccctcgacctgcgattcgtttccgtcgtcggtcctccatccagtacctacttagttaagttggtggtacgttcgggtcccgccgtaccggacccccgtaagggaacgacgggtcgtagggtaggtacgggtaaggtttgggggaagtacgttcttaacgtaccggtaacggtaacccggggacgtaaccctaaaccccgtaaaccgtaaacctaacccgttacccccggttacccctaacggaaaccggtaacggtacccggtaacgtacccgaaccgtaattacgttaaccgtaacgtaaccggtaccgtaaaccccggttaaccgaaaacccgtaaaccctaccggtttaccccctacccggttaacgtaacgggttacctacccgtcgttaccggtaccgaccccgggtacccggaccggtaaccgacccgggtcccgttaagttaccgttacgtccggtaggcccgtacggtagtttaccggaagggtacggaacgtacggtacctacgtagtaccgtcgtcgggtacggg

SEQ ID NO: 144733 - DNA, 665 bp, Homo sapiens
  misc_feature: GYAE6OF01CY07Y.5.23.C01.1.454.CMB.1.raw
  modified_base (212)..(212): a, c, t, g, unknown or other
  misc_feature (212)..(212): n is a, c, g, or t
  modified_base (315)..(315): a, c, t, g, unknown or other
  misc_feature (315)..(315): n is a, c, g, or t
  modified_base (377)..(377): a, c, t, g, unknown or other
  misc_feature (377)..(377): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtcggttcctcctcctcctggtggcagcctcccagatgggccctgtctcaggtgcagctgcaggngcggccaggactggtgaagccgttcggggaccctgtccctcgacctgcgattgttctcgtgctccatcagctactagttaagttggtcggaccgtgggtcccnccacgacccccgaaggaaaagcggcgtggagtggagttgggagatctatcaagtaccggganaccaacaactaacgaactcccgtacctacaagtagtaccgagtacaccaatactactaagtaacgaacctaacggtaacgaaaccgtaaacctaacgtttacccgtacccgtaacggtaacggttaccgtaacccgttcgtacggtaccggaaccccgggtacccggaacccgggaaccgtaacccgggtacccgttacctacgtttaccgtggtacggaccggtacggtacgtttacgagggtaacgggacaacggtactaacgtaagtacgtccggagtaccgggg

SEQ ID NO: 144734 - DNA, 927 bp, Homo sapiens
  misc_feature: GYAE6OF01C5KBB.5.23.C01.1.454.CMB.1.raw
  modified_base (322)..(322): a, c, t, g, unknown or other
  misc_feature (322)..(322): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactggtgaacgccgttcgggaccctgtccctcacctgcgtatcgtttcgtcgtcggcctccatcagtctactattaagttggtcgtaccgtcgggtccncccgaccgcccccgaagggaaacgaggtccgtagggacgtagggtaggttaggggaagtacgttaccgttaagttagaaccccccccggttaaggggaaaccgacccgaaacccgtaaaccttaaccgtaaacccgttccccggtaccccgttaacgaaaccgggtaaccggttacccggtaacggttaaccctaaacccttaagttaaccgttaacctttaaacggtaaccggtaaaaccctaaccgggttaacccgaaaaacccgtaaaaccccgttaccggtttaccccgttacccccggttaaagggtaaaccgggttacccgtaaccccggtttccggttaaccgggtttacccgggaacccccgggttacccgggaacccgggtaaccccgggtaaccccgggtaccccggtttaaccgtttaaaccggttttaaacccggttcgggttacccgggtacccggggttaccgggttaaacgtttttaccgggaaaacggggttaaccgggggtaaacccggttaaaccggggtaaacccgttttaaaccggttaaggttttaaccccgggtaccgggttaacccggtttaacccgggggg

SEQ ID NO: 144735 - DNA, 783 bp, Homo sapiens
  misc_feature: GYAE6OF01A02JZ.5.23.C01.1.454.CMB.1.raw
  modified_base (108)..(108): a, c, t, g, unknown or other
  misc_feature (108)..(108): n is a, c, g, or t
  modified_base (144)..(144): a, c, t, g, unknown or other
  misc_feature (144)..(144): n is a, c, g, or t
  modified_base (245)..(245): a, c, t, g, unknown or other
  misc_feature (245)..(245): n is a, c, g, or t
tcagatcagacacgcacgaccggtgctcgatttagtacacgtgattagggattgggcacgaccggtgctcgatttagtacacgtgattagggattggggatactttcngagactcatggacctcctgcacaagaacatgaaacncctgtgttcctcctcctcctggtgcagcctccagagtgggccctgtcctcgaggtgccagcgtgacgagggacgtccggggcccaagggtattcggggtanaacgtccccggtttaccgggggcccttcgtccccttcgacccgtggacgtacgttcgtttcgtcggtacggtctcccgtactcgtacgcctaccgttaattaacggtttcggtacggacccggttcgggttaccccgcccgaccggtaacccccgaagggaaaacggccgggtccgtagggtaacgggtacggtagggttagggaacggtaccttacgttaacggtaccggaaaggttacccgggggaacctaccggtaaacccaaacggtttaacccaacttcccccgtaacccgtacgaacgtaagtacgtacgtaccgaacctagtactaacgtacacgtaacctaacgacggaacccttaacgccttacctaccgtggaagtcccgaactcgacgtcgacccgtacggaccggtaaccgccggtacccgttcctaagttccgacgttccggaccgggtccgttaattacccgggaggttaaaccgggacgtaacggtaaccttaccgtaaatcccgggtaagtccggtaacggg

SEQ ID NO: 144736 - DNA, 749 bp, Homo sapiens
  misc_feature: GYAE6OF01BVDZV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagtccgttcggggaccctgtccctcaccgtgcgatcgtttctcgtggcctccatcagcactattaattggtcggacctggggtcccgcccgacggccccccgtaagggaaaacggcgggaccgtagggacggttggtaggttagggggagtagttccgtacgttcgaacggttaacccggggaagacccgaacccgtaaaccctaacgtaaaccgttaccccggtaccccttacgaaacgggtaacgttaccggaaccgttacccgaaccctaacgttacttaccttaaacgttaacggaacccgtaaccgttaacccgggaaaaccgtaaaccctacggtttacccctaccccgtaggtaaccggtcgaacccgttctacggtacgacccgggtaccggaccggacccgaccggtaccgtaccttagttaaccgtggtacgacggtcggttacttacggaggtaaccgggaacgacggtaaccgttaactaaggttactaccggttacggtaccgggg

SEQ ID NO: 144737 - DNA, 768 bp, Homo sapiens
  misc_feature: GYAE6OF01D53TO.5.23.C01.1.454.CMB.1.raw
  modified_base (430)..(430): a, c, t, g, unknown or other
  misc_feature (430)..(430): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactggtgacgccgttcgggaccctcgtccctcacctgcgattgtttctcgtggcctccatcagactacttaatttaagttgggtcggtaccgttcggggtcccgacccgaccggacccccgaagggaaacggacgggtccgtaggggacggttagggtacggtttgggggaagtactacgtaacgtaccgaacggtaacccgggganacccgtaacccgtaaactaaccgtaaaccttcccccggtacccctacgaacggtacggtaccggaacgttacccaaccgtaattacgttactaagtaacgaaccgtaaccgtaccgaaacctaacctacgtttccctacccgtaggtaaccggtacgtacccgttcgtaccggtaccgaaccccgggtcccggtaccggaacccgtcccgggtacccgtttaccgttaacgtttcgttcgggtacggtaccgggtacggttaacgtttaccggaagggtaacgggtaaccgaaacgggtaccttaaccgttagtaccgttccggtacggttaccgggg

SEQ ID NO: 144738 - DNA, 608 bp, Homo sapiens
  misc_feature: GYAE6OF01A0Z41.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgtccgttcggggaccctgtccctcacctgcgatgtttctcgtcgctccatcagctacttattaagttggtcggtaccgtcgggtccgcccgacgacccccgaggaaacgacggcgtgggagtacggtagttgggagagtcgtagtcacgtaccggacacaaccaactacaactcccgtccctacaacgtacgtacgacgtacacctatactctaactacgaccacgtacgaactaaccgtacgttcctcctagtaacgtcgactcgtagtccgaccgccgcgacgcggtcccgtacttacgttacgtgtacgccggtcgtacgtttacgacggacgggtacacggtactaacctagtactaccggtcggtaccggg

SEQ ID NO: 144739 - DNA, 598 bp, Homo sapiens
  misc_feature: GYAE6OF01BAPON.5.23.C01.1.454.CMB.1.raw
  modified_base (478)..(478): a, c, t, g, unknown or other
  misc_feature (478)..(478): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggaccctgtccctcacctgcgatgtttctcgtggctccatcagcactattaattggtggacctgggtccgccacgcccccgaggaacgaggctgggagtgggagttgggggagagtctatcagtaccgggagccaccaactacaactcccgtccctcaagacgtcgacgtcaccatactctatacgacacgtacgaaccaaccacgttcctacccgtagtaacggtcgacccttcgngttcgacccggcccggaccggaccgaccggtcccgttcgtaacgttacgtggtcgcggtcggtatttccgaggacggggaccaagggtaccttaacgtagttactccggtacggtccggg

SEQ ID NO: 144740 - DNA, 412 bp, Homo sapiens
  misc_feature: GYAE6OF01BE8QK.5.23.C01.1.454.CMB.1.raw
  modified_base (394)..(394): a, c, t, g, unknown or other
  misc_feature (394)..(394): n is a, c, g, or t
  modified_base (400)..(412): a, c, t, g, unknown or other
  misc_feature (400)..(412): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcgccctgggctgcctggtcaaggactacttcccgtgtctgatctgagcgggctggcaaggcncatagnnnnnnnnnnnnn

SEQ ID NO: 144741 - DNA, 577 bp, Homo sapiens
  misc_feature: GYAE6OF01BRP2J.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggacctgggtccgccagcccccaggaacgaggctggagtggattggggagatcgtatcagtaccgggagcaccaactacaactccgtaccctcaagagtcgagtccaccatatctaatacgactacgtacgaaaccaaccacgttcctaccctggaacggtcgaaccctcgtcggttcgacccgccgaccggaccacgggtcccgtactacgttacctgtcggcgcggtatttacgacggtagggacctagggacctacgtaatagtccgacgttccggg

SEQ ID NO: 144742 - DNA, 585 bp, Homo sapiens
  misc_feature: GYAE6OF01A2ITR.5.23.C01.1.454.CMB.1.raw
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (423)..(423): a, c, t, g, unknown or other
  misc_feature (423)..(423): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggaccgtgggtcccgccacggcccccaagggaaacgnggctaggagtaggagttgggganagtctatcagtaccgggagcaaccaactacaactcccgtacctacaagacgtcgacgacaccatanactatagacacgtacgaaccaacctagttcctaccgtagaacggtcacctcgtagtcgacccgccggacgacgaccggccgtctaacgtcgtacgtcggccggtcgtatttacggaggacgggtaacgacggtaacttacttaagactcggtacgtaccggg

SEQ ID NO: 144743 - DNA, 408 bp, Homo sapiens
  misc_feature: GYAE6OF01EIH64.5.23.C01.1.454.CMB.1.raw
  modified_base (399)..(408): a, c, t, g, unknown or other
  misc_feature (399)..(408): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtctccccctggcaccctctccaagagcacctcgtggggcacagcggccctgggctgcctgtcaaggactacttcccgtgtctgatctgagcgggctggcaaggcgcatagnnnnnnnnnn

SEQ ID NO: 144744 - DNA, 590 bp, Homo sapiens
  misc_feature: GYAE6OF01A4SNA.5.23.C01.1.454.CMB.1.raw
  modified_base (491)..(491): a, c, t, g, unknown or other
  misc_feature (491)..(491): n is a, c, g, or t
  modified_base (577)..(577): a, c, t, g, unknown or other
  misc_feature (577)..(577): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggaccctgtccctcacctgcgatgtttctcgtggctcatcagcactattaatggtcggacctgggtccgccgacgcccccgagggaaagaggccgtggagtggagttggggagtactctagtcgagtaccgggagccaaccaactacaaacgtcccgtaccctacgaaacggacgtacgagtcaaccagtactactatacgactaacgtacgaaactaacctagttacctacccgtagacggtcaccttntacggtcgacccgtccgccgacgccggaccgtactacttacgtgcggcgtcggtattcggagacggggacacggtacctataatcncggtcggtccggg

SEQ ID NO: 144745 - DNA, 730 bp, Homo sapiens
  misc_feature: GYAE6OF01EKDSG.5.23.C01.1.454.CMB.1.raw
  modified_base (495)..(495): a, c, t, g, unknown or other
  misc_feature (495)..(495): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcaggtgcagctgcaggaggtccgggcccaggactggtgaacgtccgttccgggaccctcgtccctcaccgtgcgtattgtttctcggtcggctccatcagctacttattaagttggtacggaccgttcgggcccgtccgaccggacccccgaagggaaacgagggccgtgggtacgtgggtaagttacggggagtagttacgtaatacgaaggtacccgggaggacccaaccaaccgttacgtaaccgtcccgtaccctacgaacggtacgtcgaacgtacccaactacttacttactaanaacggaacctaaccggtaccaaacctaacccgtaccgttttaccaccccgttaaaggtaacggtaccgtaccttaccggtacgacccgggaccccggtcccggaacggtacccgaaccgggtcccgttaacgtacgtttaacccgtgggttaccggacggttaccgggtatttaccggacgggaacggtaaccgacggtaaccttagttaagtacgtccggtaacggttccgggg

SEQ ID NO: 144746 - DNA, 406 bp, Homo sapiens
  misc_feature: GYAE6OF01DA09E.5.23.C01.1.454.CMB.1.raw
  modified_base (400)..(406): a, c, t, g, unknown or other
  misc_feature (400)..(406): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcggctggcaggcgcatagnnnnnnn

SEQ ID NO: 144747 - DNA, 614 bp, Homo sapiens
  misc_feature: GYAE6OF01BGLQL.5.23.C01.1.454.CMB.1.raw
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctggtctcaggtgcagctgcaggtagcgggcccaggactggtgaagtccgttcggggaccctgtcccctcactgcgatgttctcgtggctccatcagcactataagttggngtaccgtggtccncgtacgccccaaggaaagcggactggagtggagttcggggantacatcaacgtaccggancctaaccaactaacaacttccgaccctagaacgagtcgaagtcaaccagtactctaatacgacaacgttacgaaacaacccgtagtttacccaccgttagaacggtcgacccttcgtacggtaccggacccgtccggtaccgaacgtacccggtccgtacgtaactacgtccggtagccggtcggtaattcggaacggtacgggactaacgggtactacgttaagtacgtccgtacgtacggg

SEQ ID NO: 144748 - DNA, 617 bp, Homo sapiens
  misc_feature: GYAE6OF01AVE27.5.23.C01.1.454.CMB.1.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccaccgatgggccctgtctcaggtgcagctgcaggagtcgggcccaggactggtgaacgccgttcgggaccctgtccctcacctgcgatgttctcgtgctccatcagcactatatgngactggtccncncgcccgaggaagngctggagtgagttggganagtctatcacgtacggganaccgactaactacactcccgtcccacgaagacgtacgagtaccaacctatactactaatacgaactaccgtaccgaaacctaacctacgtttccacccgtaggaacggttcgtaccctcgtaggtacccggacccggcccgacggaaccgacccggtccgttaacctacgtttaccgtgtaccggtcggtacggttacttacggacgggtacgggaactacgggtaacttaacgtagttacgtccggtaccggttaccgggg

SEQ ID NO: 144749 - DNA, 560 bp, Homo sapiens
  misc_feature: GYAE6OF01ER1ZR.5.23.C01.1.454.CMB.1.raw
  modified_base (521)..(521): a, c, t, g, unknown or other
  misc_feature (521)..(521): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggacctgggtccgccacgcccccagggaagacggctgggagtggagttggggagatctatcgagtaccgggagaccaccgaactacgaactcccgtaccctacaagagtcgagtccaccatatctaatacgacacgtacgaacaaccagttacctcccgtagtaacgtcgaccctcgtacgcgacccgccggcggaccacggcctatcttactactgtcgtcgnggtattcgaaggaggacgaggactatactgtccgtacgg

SEQ ID NO: 144750 - DNA, 500 bp, Homo sapiens
  misc_feature: GYAE6OF01AC2UK.5.23.C01.1.454.CMB.1.raw
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (459)..(460): a, c, t, g, unknown or other
  misc_feature (459)..(460): n is a, c, g, or t
  modified_base (462)..(462): a, c, t, g, unknown or other
  misc_feature (462)..(462): n is a, c, g, or t
  modified_base (464)..(468): a, c, t, g, unknown or other
  misc_feature (464)..(468): n is a, c, g, or t
  modified_base (470)..(485): a, c, t, g, unknown or other
  misc_feature (470)..(485): n is a, c, g, or t
  modified_base (487)..(500): a, c, t, g, unknown or other
  misc_feature (487)..(500): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcaggagggaccacggtcatcgtctcctcagcctccaccagggcccagtcggtcctcccccgtggccacccctcctaccgaagacgccacctcgtcgggggcacgacgccggcccgtgggctcgccgtggtcgaacggctaccgttcccgtgtcgttgacttcgtgacggccgggtcgtgggaccgtaacgggccgcgaagttacggnacngcgcngcacgnngngnnnnngnnnnnnnnnnnnnnnngnnnnnnnnnnnnnn

SEQ ID NO: 144751 - DNA, 763 bp, Homo sapiens
  misc_feature: GYAE6OF01DYP3A.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggccaggactggtgaagccgttcggggaccctcgtccctcacctgcgattcgtttcgtcgtcggcctccatcagcacttattaagttggtcggacccgttcggggtcccgccgaccggacccccgaagggaaacggaggccgtgggacgtggggagtttggggacgtattacgtacgtacgaacggttacccggggagaccgaacctaaacgtaacctaaacttccccggtacccctacgtaaacggtacgtaccggacggtacccaacctaattaactaccttaagtaacgtaaccgtaaccggtaaccgaaaacccaaaccctacgttaccctaccccgtaggtaacggttaccgtaccgttccgttacggtacgtaaccccggccggtaacccggacccgaccgggtacccgttaccgttacgtttaaccgtggttaccggaccggtaccgggttacgtttaccggaaacgggtaaacgggggtaaccctaacggggtaacccttaacccgttaatttaaccggtccgggtaaccggttccggggg

SEQ ID NO: 144752 - DNA, 740 bp, Homo sapiens
  misc_feature: GYAE6OF01BPQW3.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccgagagtcgggccctgtctcgaggtgcagctgcaggagtcgggccaggactggtagaacgtccgttcgggaccctcgtccctcgacctgcgagttcgttctcgtcgctccatcacgctacttagttaagttcggtacggaccgttcgggtcccgccgtaccggaccccgaagggaaacggcggaccgtagggtaggttaggtaggttggggaagtacgtacgtacgtacgaacggtaccgggacgaccgaaccaaactaaccgaacgttccccgtacctacgaaggtacgtacgactacaacctagttaactactaacaacgtaccgaacgtaccgaaacctaaccgttacgttacctacccgtaaggtaaccggtacgtacccgtacgttaccgtaaccggaccccggtaccggacccggtaaccgtacccggggtacctttaacgttaaccggtttccgtacgggtccggtaccgggtccggtttaacgttacggaaacggggtacggtaaccgtaacggttaaccttaacgttaagttaccgtacggtccgggttacggg

SEQ ID NO: 144753 - DNA, 789 bp, Homo sapiens
  misc_feature: GYAE6OF01C2AIV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtcggttcctcctcctccgtggtggcagcctcccagagtcgggccctgtctcgaggtcgcagctgcgaggacggtcgggcccgaggacgtggtagaacggtcccgttaccgggaccctcggtcccctcgacccgtgacgtacgttcgtttccgtcgtcggtaccttccgaacttccgagtacctaaactttaagtttaaacggtttcggggtaccggtaacccggttccgggtaccccgacccgacccggaccccggaagggtaaaacggcgggtacgtagggtaaggtagggtacggttaggggataccgttactaacgtacgtaacggtacccgggaacgaaccaaccgtaaacgtaaccgtaaccgttccccgtaacccgtacgaaggtacgttaccgaacgtaccaacctattaacgtactaacgtaacgaacctaaccgtaacaaacctaacctcgttccctaaccgtaggtacgtaccgtaacctcgttacggacccggtacccggccggtaccggaaccgtacccgggtacgttaccttaagttccgtcggtccggtaccggttacgttacgttacgggaacgggaacggtacgtaacgtacttaacgtaggtaccgtccggtacgggtacggg

SEQ ID NO: 144754 - DNA, 698 bp, Homo sapiens
  misc_feature: GYAE6OF01DO8ZC.5.23.C01.1.454.CMB.1.raw
  modified_base (363)..(363): a, c, t, g, unknown or other
  misc_feature (363)..(363): n is a, c, g, or t
  modified_base (416)..(416): a, c, t, g, unknown or other
  misc_feature (416)..(416): n is a, c, g, or t
tcagatcagacacgcacgaccggtgctcgatttagtacacgtgattagggattgggcacgaccggtgctcgatttagtacacgtgattagggattggggatactttctgagactcatggaccctcctgcacaagaacatgaaacacctgtggttcctcctcctcctggtggcagctcccagatgggccctgtctcaggtgcagctgcaggagtcgggcccaggactggtgaacgccgttcggggaccctgtccctcacctgcgattgtttctcgtggcctccatcacgcactattaagtggtcggtaccgtcgggtccgcccacgacccccgaaggaacgaggcgtgggagtggagttggganagtctagtcgagtaccgggagaccaaccgtaactacaacgtcccgtaccctanaacggtagtaccgtacgtaccaacctataacgtactaagtaacgaactaccggttaaccgaaacctaaacccgtacgtttacccgtacccgttaggtaacggttacgtacccgttacgtacggttaccggaacccggtcccggaccggtaaccgacccgggtcccgttaccgttaacgtttaaccgtcgggtcggccggtaccggttagttttaccggaacgggtaacgggaccgtaacggtaacctttaacgtaagttaacgtccggtacggtacccgggg

SEQ ID NO: 144755 - DNA, 767 bp, Homo sapiens
  misc_feature: GYAE6OF01EH6NL.5.23.C01.1.454.CMB.1.raw
  modified_base (267)..(267): a, c, t, g, unknown or other
  misc_feature (267)..(267): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtgttcctcctcctccgtggcgcactcctacgagtcggtccgtcgtcgtcacgtggtcgacgcgcgtacgacggaggtcggccgacgagtgtgacgaccgtccggtccgccgtccgtccnccgtacgcgtacgtgttttccgttcggtcggcgtcctacgtactacgactaaccttaagtttaagttcggtcgggaccggtcggtccggcccaccggaccccgaacggtaaggacggcgtcggtagggtacggtaggttagggtacggactcgtactacgtacgtaacgggaccgacaaccgtaaactaacgtaacccgttacccgtccccgtaacgtaaacggaaccgttacggaacgtacccgtaacctaaccgttagtttaaccctaagtaacgaaccgtaaccggtacccgtaaacctaaaccgtacgtttccgttacccctaaggtaacggtcgtacctccgtaggtaccgacccgtaccgggccgtaaccgtaccggtacccgtttcttaaagtaccgttcggacggtccggtacggttacgtttacggaacggacggggtaaaccgacgttaaccgttacttaacgtgtaccccgggtacggtggtaccgggg

SEQ ID NO: 144756 - DNA, 631 bp, Homo sapiens
  misc_feature: GYAE6OF01B7BL3.5.23.C01.1.454.CMB.1.raw
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
  modified_base (550)..(550): a, c, t, g, unknown or other
  misc_feature (550)..(550): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtacgaacggcctttcgggggacccttggtcccctcaccgtgcgattgtttccgtcgtggacctccgaattcgagtcacttaattaagttgggtggaaccgttgggtcccgcccgacgcccccaagggaaacgaggcctgggtacgtggagttgggacgatcgtaatcgaagtaccggggaanccgaacctaactaacgaacctccgtaccctanaacggacgtacggagtaccaaccgatacttactaatacgaacaccgtacaacaacctacgttccaccctggaacgtcgacctcgtcgtaccgacccgtccggacggacnccggccttacgtacttaccgtgtcgccggtcgttagttacgaggacggacgaggtacctatagtactcggacgttaccggg

SEQ ID NO: 144757 - DNA, 708 bp, Homo sapiens
  misc_feature: GYAE6OF01DK252.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagcctcccagagtcgggccctgtctcgaggtgcgagctggcgagggagtccggggcccgaggtaccgtgggtcggaacggtccggttccggggaccctcggtcccctcaccgtgcgtattcgtttcgtcgtcggctccatcgagcacttattagtggtcggaccgtcggtccgccgaccgaccccgaaggaacgcggcgtagggagtagggtagtggggaagtacgtacgtatcgaacggtaccgggagaccgaacctaacgtaccaaccgtccgtacctacgaacggtacgtaccgacgtaccactatactactaagtacgaaccgtaaccgtaccgaaactaaccgtacgtttaccctaccgtacggtaaacggttccgaacgttccgtacggtacccggacccgtccggaccggtacgacccggtcccgtattaccggttacgtcgggtacgacggtaccggtagtttacggaagggaccgggtaacgtacggtaccgttacgttaacgttaccggtcggtacggttaccgggg

SEQ ID NO: 144758 - DNA, 407 bp, Homo sapiens
  misc_feature: GYAE6OF01DYATW.5.23.C01.1.454.CMB.1.raw
  modified_base (380)..(380): a, c, t, g, unknown or other
  misc_feature (380)..(380): n is a, c, g, or t
  modified_base (403)..(407): a, c, t, g, unknown or other
  misc_feature (403)..(407): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatccacgtctgggcagagggaccacggtcatcgtctcctcagcctccaccaaggcccatcggtcttccccctggccaccctcctccaagacgcacctctgggggcacgagcggccctcgggctgcctggtcaaggactacttcccgtgtctgatcngagcgggctggcaggcgcatagnnnnn

SEQ ID NO: 144759 - DNA, 592 bp, Homo sapiens
  misc_feature: GYAE6OF01D07M4.5.23.C01.1.454.CMB.1.raw
  modified_base (328)..(328): a, c, t, g, unknown or other
  misc_feature (328)..(328): n is a, c, g, or t
  modified_base (419)..(419): a, c, t, g, unknown or other
  misc_feature (419)..(419): n is a, c, g, or t
  modified_base (457)..(457): a, c, t, g, unknown or other
  misc_feature (457)..(457): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggacccctgtccctcacctgcgatgttctcgtggctccatcagcactattaattggtggacctgggtccgccagcccccaggaacgngcgtgggagtagggagttggggagatctatcagtaccgggagcgaaccaacgtacaactcccgtaccctcgaaagcgtacgagtccaactntactctatacgacaccgtcgaaacctaacctacgttcncccgtagacgtcgacctgtcgtacgacccgccggcggacaccggccgttactacgttaactggtcggcggtccggtatttccggaagtacgggtacgaaacggtctaacttagtaacgtccggagttacccgggg

SEQ ID NO: 144760 - DNA, 610 bp, Homo sapiens
  misc_feature: GYAE6OF01BK4UW.5.23.C01.1.454.CMB.1.raw
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgttctcgtcggctccatcagcactattaattggtggacctgggtccnccacgccccaggaacgngctaggagtggagttggggagagtctatcgagtaccgggagccaaccaactacaactcccgtaccctacaagacgtacgacgtaccaccgtatactactatagaccacgtaccgaacctaaccgtacgttacctcccgtaggtaacggtcgaaccgttctagtaccgacccggccgccggaccaccgggtaccctacgttagttacctgtcgcggtccggtatttacggacgtaacggggacaacgggtaccttacgtaagtaacgtcggtaacggtaccggg

SEQ ID NO: 144761 - DNA, 583 bp, Homo sapiens
  misc_feature: GYAE6OF01B6AH4.5.23.C01.1.454.CMB.1.raw
  modified_base (381)..(381): a, c, t, g, unknown or other
  misc_feature (381)..(381): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactgggtgaacgccgttccggggaccctgtccctcacctgcgatgtttctcgtggctccatcagcactattaagttggtggacctgggtccgccgacggcccccgaggaaaggcggcgtgggagtcggagttggggagtatcgtatcacgtaccggganccaacctaactaacaactccgtaccctacgaagagtcgacgtccaaccatactctaagtacgacgaacgtacgaacctaaccgacttacctccgtagacgtgaccctcgtcgtacggacccgtccggacgacgaccggtaccgtctacgttactcgtgcggtcgtagttcgaggaggacgagtactatatgtccgagtcggg

SEQ ID NO: 144762 - DNA, 712 bp, Homo sapiens
  misc_feature: GYAE6OF01ETRBL.5.23.C01.1.454.CMB.1.raw
  modified_base (311)..(311): a, c, t, g, unknown or other
  misc_feature (311)..(311): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtgggccctggtctcgaggtgcagctgcaggacgtccgggccaggactggtagaacgtccgttcgggaccctgtccctcacctgccgagttcgtttcgtcgtggcctccatcagctactattaagttggnggacgtcggtccgccgaccgccccgaaggaagcggcgtagggagtacggaggtgggagtaagtcgtaatacgacgtaccgggataccgaaccaaactaacaacgttccgtaccctagaagtcgtacgacgtacaaccgtatacttacgtaataacgacgtaccgtaaccgaacctaaccgtacgttacctacccgttaagaacggttaccgaaccgttcgttacggtaccgaaccccggtaccggaccggtaaccgtaacccggtacccgtttaaccgttaaccgttaccggttacgggtacggtaccgggtaccggttaacgttttaccggaaacgggtacggggtaaacgaacggttaacgtaaccttaagttaaccgtccggtacggttaacccgggg

SEQ ID NO: 144763 - DNA, 813 bp, Homo sapiens
  misc_feature: GYAE6OF01C9JFI.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcgaggagtcgggcccaggacgtggtgaacgccgttcgggaccctgtccctcaccgtgcgatcgtttcgtcgtggcctccatcagacactattaagttggtcggtaccgtcgggtccgcccgtacgccccccgaagggaaacggaacggtccgtagggacggtacgggacggttagggggaagtacgttccgttaacgtaccgtaacggttaacccgggggaagacccaaacccgtaaacctaccgtaaaccgttccccggttaccccttaacgaaacgggtacggtaaccggtaacggttcccgaaacctaagttaacgttaccgttaaagttaacggaaacccgtaccgttaacccggtaaaacccgtaaaccccgtaaccggtttacccttcccccggttaaggtaaccgggttaccggtaacccgtttcggtacgttacccggacccgggcccggtaccgggacccgtaacccgggtccgttaccgttacgtttaccgtcgggttacggccgggtaccgggttagttttaccggaacggggtaacgggtaccgtaaacgggtacttaaaccgttattaaacggtccggttaaccggtacccgggg

SEQ ID NO: 144764 - DNA, 730 bp, Homo sapiens
  misc_feature: GYAE6OF01CX9AV.5.23.C01.1.454.CMB.1.raw
  modified_base (142)..(142): a, c, t, g, unknown or other
  misc_feature (142)..(142): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacagacatgaaacnctgtgtcctctcctcgtggtgcagctccagacgtcggccctgtcctcgaggtgcagtctgcgtaggacgtcggaccgaggtacgtggtacgaacgtccgttacgggaccctgtcccctacgacctcggtacgtacttcggtttcctcggtacggccttaccgattccgacggtcctacgttaagttacgtggtaccgtacgttcgggacctaccgacggacccgtaaggaacgtacggcgtagggtacgtaggtacgtacggggaactacttacgtaacgtacgtaacggtaccggaacgtccgtaaaccgtaacgtacgtaacctccccgtaaccgtacgaacggtacgtacgaaccgtcgtaacctacgttacgtaacgttaacgtacgtaacgtaaccgttacgtaaccgtacgttccgtaccgtaccgtagtacggtctacgttcgtacggtaccgtccggtaccgacggtaccgtaccgtacgttaccgttaagttccgtacggtacgtaccggtacgtaagtttaccggaggttaacgacgttaacgtacgtaacgtacgttaccgtcgtaacggttccggg

SEQ ID NO: 144765 - DNA, 678 bp, Homo sapiens
  misc_feature: GYAE6OF01BE7YO.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcgaggtgcagctgcaggagtcgggcccaggactggtagaacgccgttcgggaccctgtccctcacctgcgtatgttctcgtggctcatcagcactattaagtggtcggaccgtcgggtcccgtccgacgtacccccgaaggtaaacggacggcgtacgggaggtagggtaacggttggggaactagtacgtatacgagtaccgggacgaccaaccgaactacaactcccgtacctacgaagacgtacgactaccactatactactaatacgaaccacgtacgaaacctaacctacgttacctacccgtaggtaacggtcgtaccttcgtcggtaccggtacccgcccgggtacccgaaccgtacccgggtaccgttacctaacgttacggtcggttccggtccgggtaccgttacgtttaaccggagggtaaccgggaacgtaacggtacttaaccgtaattacggtccggtacgttaccggggg

SEQ ID NO: 144766 - DNA, 739 bp, Homo sapiens
  misc_feature: GYAE6OF01AIHQ8.5.23.C01.1.454.CMB.1.raw
tcagatcagacacgcacgaccggtgctcgatttagtacacgtgattagggattgggcacgaccggtgctcgatttagtacacgtgattagggattggggatacttttctgagactcatggacctcctgcacaagaacatgaaacacctgtggttcctcctcctcctggtggcagcctcccagagtgggccctgtctcgaggtgcagctgcgaggacggtcgggcccagggacgtggtacgaacgtcccgttccggggaccctcggtcccctcgacccgtggcgtagttcgtttcgtcggtcggcctccactcacgctaacttagttaagtcgggtcggtacccgttcgggtcccgaccgaccggacccccgaagggtaacggacgggcgtacgggaggtcggtaaggttacggggaagtacgtcgtaagtaccgaaacggtaccgggacgaacccgtaacctaaacgtaccctaacccgttccccgtaaccgtacgtaaacggtacggtacgaacgtacaaccgtactaacgttactaagtaacgaaccgtaccgtaaccgaacctaaccgtcgttacctaccgtagtaacggtcgaccttcgacgttacccggaccggtccggacccgtaacggtaccccggtccgtaacgttacgttccgtggtaccgtcgggtaacgttcgttaacggaggtacgggtaaccaggtaccttaatacgtagtaccgtcggtaccggg

SEQ ID NO: 144767 - DNA, 611 bp, Homo sapiens
  misc_feature: GYAE6OF01DQT4E.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcgaggagtcgggcccaggacgtggtgaacgccgttcggggaccctgtccctcacctgcgtatgtttctcgtggcctccatcacgctactattaattggtcggaccgtcgggtccgccgacgcccccgaagggaacgaggcgtgggagtggtagtgggagatcgtagtcgagtaccgggagaccaaccaactacaactcccgtaccctacgaagtcgtacgacgtaccaacctatactctaatacgaactaccgtacgaaactacctagttcctaccgtagtaacggtcgtacctacgtcggtacgacccgccggacggacgaccggtccgtacgtacgttacgtgtcgcgtacggtattaccgaggacggacgtacggtactaacgtagtacgtcggtacgtcggg

SEQ ID NO: 144768 - DNA, 554 bp, Homo sapiens
  misc_feature: GYAE6OF01BVRNV.5.23.C01.1.454.CMB.1.raw
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggacctgggtccgccagcccccgaggaacgaggcgtggagtggattgggganatctatcagtaccgggancaccaactacaactccgtccctacaagagtcgactcaccatactctaatacgacacgtacgaacaaccagttacctccctagaaggtcgacctctacgtacgacccgccgcggacgaccggccgtactacttacgtgtgccggcggtattcgaggacgggacaggtactacgtatcgtcgacgtcgg

SEQ ID NO: 144769 - DNA, 403 bp, Homo sapiens
  misc_feature: GYAE6OF01B9739.5.23.C01.1.454.CMB.1.raw
  modified_base (399)..(403): a, c, t, g, unknown or other
  misc_feature (399)..(403): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggcctgggctgcctggtcaaggctacttcccgtgtctgatctgagcggctggcaaggcgcatagnnnnn

SEQ ID NO: 144770 - DNA, 695 bp, Homo sapiens
  misc_feature: GYAE6OF01D63CE.5.23.C01.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctccagatgggccctgtctcaggtncagctgcaggacgtcgggcccaggactgggtgaacgcccgttcggggaccctgtcccctcgacctgcgtagtgtttctcgtggctccatcagcactattaagttggtcggtaccgtcgggtccaccgtaccgcccccgaagggaaagacggcgtagggagtagggtaggtggggaagtatcgtatcgagtaccgggacacgaaccaactaaccacttacccgtccctacgaaacgtcgtaccgagttaccaaccgtatacgtactaacgacgaacctaacggtaccgaaacctaaccctacgtttccctacccgtagtaacggtcgtaccgtaccgtacgttacggaccccgtccggtacggaacccgtaccgggtcccgtaccgttaacgttaccgttacgtcgggtaccggtcggttaacgtttacggagggtaaccgggaaccgtaacggtaaccgttaacgtaagtttacccgtacggtacggttacccgggg

SEQ ID NO: 144771 - DNA, 725 bp, Homo sapiens
  misc_feature: GYAE6OF01E4TS1.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagctcccagatcgggccctgtctcgaggtgcagctgcgaggacgtccgggcccaggacgtggtacgaacgtcccgttccggggacccttcgtcccctcgaccgtgcgtagttcgtttccgtcggtcggtcctccactcacgtacctacttagtttaagtgggtacggaccgttcgggtcccgacccgaccggacccccgaaggaacgcggcggtagggaggtcgggtaggttacgggagtactccgtagtacgacggtaccgggacgaccaaccgtaactaccgtaccgtcccgtaccctacgaacgtcgtaccgacgtaccactatactactatacgacgtaaccgtacgaacctacctacgttccctaccgtagtaacggtcctaccgttcgtaccggtccggaccccggtccggacccgtaccggtaccggtacccgttacgttaccgttacggtcgtaccggtaccggtcgttacgttaccggaagggtaaccgggtacgtaacggtaacccttaacgttaacgtaccgttcccggtaccggttaccgggg

SEQ ID NO: 144772 - DNA, 537 bp, Homo sapiens
  misc_feature: GYAE6OF01AL4JL.5.23.C01.1.454.CMB.1.raw
  modified_base (441)..(441): a, c, t, g, unknown or other
  misc_feature (441)..(441): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggcccctgtctcaggtgcagctgcaggagtcgggcccaggactggtgaagccttcggggacccctgtccctcacctgcgatgtttctcgtggctccatcagcactattaattggtggacctgggtccgccagcccccaggaaagaggctgggagtgggattggggagatctatcataccgggagcaaccaactacaaatccgtccctcaagagtcgagtcaccatatctaatagaacacgtacgaaacaaccagttcnccctgaaggtgaacctctgtgacccgccggcggacacgggccgtctattactgtgcgcggatttcgagagggacaggactacaatatcgacgtcgg

SEQ ID NO: 144773 - DNA, 585 bp, Homo sapiens
  misc_feature: GYAE6OF01EPCNG.5.23.C01.1.454.CMB.1.raw
  modified_base (269)..(269): a, c, t, g, unknown or other
  misc_feature (269)..(269): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
  modified_base (433)..(433): a, c, t, g, unknown or other
  misc_feature (433)..(433): n is a, c, g, or t
  modified_base (466)..(466): a, c, t, g, unknown or other
  misc_feature (466)..(466): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcgggaccctgtccctcacctgcgatgtttcncgtgctccatcagcactattaatggtggacctcggggtccgccacgccccgaggaacgagcgtggagtcggagttgggganatctagtcagtaccggganaccaccaaactacactcccgtaccctacgaagtacgtcgacgtaccgaacctattactcgtaanacgacaccggtacaaacctaacctacgtttccncccgtagaacggtcgacctgtgtcgacccgcgtccggacacggccttctacttacgcgtgccggtacgtattcggaggacgggacaacggtaccttaactattacgtccgtagtcgggg

SEQ ID NO: 144774 - DNA, 425 bp, Homo sapiens
  misc_feature: GYAE6OF01DVTIA.5.23.C01.1.454.CMB.1.raw
  modified_base (417)..(425): a, c, t, g, unknown or other
  misc_feature (417)..(425): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctgggcagagggaccacggtcatcgtctcctcagcctccaccaagggcccatcggtccttccccctggccaccctcctccaacgacgccacctcgtcgggggcacgacgccggcccgtgggctcgcctggtcaaggacctacttcccgtgtctgatctgagcggctggacgaaggcgacagtagnnnnnnnnn

SEQ ID NO: 144775 - DNA, 731 bp, Homo sapiens
  misc_feature: GYAE6OF01DMHJG.5.23.C01.1.454.CMB.1.raw
  modified_base (219)..(219): a, c, t, g, unknown or other
  misc_feature (219)..(219): n is a, c, g, or t
  modified_base (425)..(425): a, c, t, g, unknown or other
  misc_feature (425)..(425): n is a, c, g, or t
  modified_base (722)..(722): a, c, t, g, unknown or other
  misc_feature (722)..(722): n is a, c, g, or t
tcagatcagacacgcacgaccggtgctcgatttagtacacgtgattagggattgggcacgaccggtgctcgatttagtacacgtgattagggattggggatactttctgagactcatggacctcctgcaacaagaacatagaaaccacctggttcggttccctcctcctccgtgggtcggcacgcctcccgagagtcgggccctgtctcgaggtcgacngctgacgagggacggtccgggacccgaggtacgtggacgtaaccggtccggttaccgggacccttcgtccccgtactaccgtggtaccgttacgtttcgtttccgtcggtcggcctacccgatacgacgaccttaacgtttaagtttacggtcgggtaccgtaccggttcggtcccgaccgacccggtacccggaaaggtaacggnggtaccggagggtaacggtgggtaacgggttgggaactcgttacgaactacggacggtacggacaacctaaccgtaactacgtacccgtcccgtactacggacgtacgacctcgaacctacgattacgtaacacgaacgacctacgaccaaacctacgtccttaccgtacgtacgaagttcccaactcgtacggccggacccgaccgggtacgacccgtagtcccgttattacgtcgtcggcgtaccggcggtttacgacggacggcgtaacgacgtaactacgtagtcgtaccggnggtaccggg

SEQ ID NO: 144776 - DNA, 409 bp, Homo sapiens
  misc_feature: GYAE6OF01BS9X1.5.23.C01.1.454.CMB.1.raw
  modified_base (405)..(409): a, c, t, g, unknown or other
  misc_feature (405)..(409): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtcgtggggcagagggaccacggtcatcgtctcctcagcctccaccaaggcccatcggtcttccccctggcaccctcctccaacgacgcacctcgtcgggggcacagcggcccgtggctgcctggtcaaggactacttcccgtgtctgatctgagcggctggcaaggcgcatagnnnnn

SEQ ID NO: 144777 - DNA, 655 bp, Homo sapiens
  misc_feature: GYAE6OF01DWF03.5.23.C01.1.454.CMB.1.raw
  modified_base (382)..(382): a, c, t, g, unknown or other
  misc_feature (382)..(382): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggacgtggtgaagccgttcgggaccctcgtccctcacctgcgatgtttctcgtgctccatcagctactattaattggtcggaccgtcgggtccgcccgacgccccgaggaaagacggcgtggagtgggagttggggagtatctaagtcgaacgtaccggganacaaccctaactacaacgtcccgtccctagaacgtacgtacgacgtccaacctagtactacttaatacgaactacccgtacgaaaccaaacccgtacgtttaccctacccgtaggtaacggtcgtacccgttcgtacgtaccggacccgtcccggaccgggacctaccggtcccttacgtacgttacgtgtcggaccggtcggttaactttcggaacgggtacgggaacgaacgggtacctaaacgttataacgttccggtacggttccgggg

SEQ ID NO: 144778 - DNA, 477 bp, Homo sapiens
  misc_feature: GYAE6OF01ANWVI.5.23.C01.1.454.CMB.1.raw
  modified_base (193)..(193): a, c, t, g, unknown or other
  misc_feature (193)..(193): n is a, c, g, or t
  modified_base (323)..(323): a, c, t, g, unknown or other
  misc_feature (323)..(323): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (454)..(458): a, c, t, g, unknown or other
  misc_feature (454)..(458): n is a, c, g, or t
  modified_base (460)..(465): a, c, t, g, unknown or other
  misc_feature (460)..(465): n is a, c, g, or t
  modified_base (467)..(477): a, c, t, g, unknown or other
  misc_feature (467)..(477): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttcctcctagaaggtcacctctgtcgaccgccgcggacacggcctctattacngtgcgcggtattcgagagggacaggactactatatcgagtcgtggggcaggacgggaccacggtcagtccgtctcctcgacgccctaccgaccgaacggcccacgttccgtccccttcccccgtcgcccncccctccgaccgaacgccgcctaccgtcggtcgggaccacgacggcccggccgtcggcgtcgccgtcggtacgacgtaccttccgtcccgtgtcctgtactcgtgcggcggcgtcggacgacgcgnagngnnnnngnnnnnngnnnnnnnnnnn

SEQ ID NO: 144779 - DNA, 1003 bp, Homo sapiens
  misc_feature: GYAE6OF01BO19F.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcgaggtgcagctgcgaggacgtccgggacccaggacgtggtacgaacgtcccgttccggggaccctcgtcccctcaccgtggcgtagttcgtttcgtccggtcggtcctaccgatcgacgtacctaacgtttaagtttaacggttcgggtaccgggtacccggtttccggggtacccccgtaccccggaaccccgggtaccccccggaaaggggtaaaaccggtacgggtaccggttaacggggtaaggggttacgggttaacggggtttacgggggaacggttacgtttaccgttaacggttaacccgtaaacggggttaaccccggggaaccgtaaccccgtaaaacccgtaaaacccgtttaaacccgtaaaccccgtttacccccggttaacccccgttaaacggtaaaccgggttaaccggttacccggtaaaccgttaaccccgtaaaccgttaaactttaaccgttaacccgtaaacgttaaccggtaaacccgtaacccggttaacccgtaaaaccccgtaaacccgttacccggttttaaccccttacccgggttaaacgggtaaccgggttacccgttaacccgtttaccggttaccggtaaccccgggtaccccgggtaccccgggtaacccgggtaacccggtaccccggggttacccgtttaccgtttaaacggttaccggttccgggtaccggtaccggtaccgggtttacgtttaaccgggacgggtaaccgggtaacctaacggttaaccgttaacgttaacgttaccggttaccggtaccgggttaccgggg

SEQ ID NO: 144780 - DNA, 648 bp, Homo sapiens
  misc_feature: GYAE6OF01A95CF.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcgaggtgcagctgcaggagtccgggccaggactggtgaacgtccgttccggggaccctcgtccctcgacctgcgtattgtttcgtcgtcggtctccatcagctacttattaacgttggtcggtaccgtcgggtcccgccgaccgccccgaagggaaacgcggcgtagggtacgtggagttgggagtactcgtatcgagtacggacacaacaactacaactccgtaccagaacgtacgtacgacgtaccactatactactaactagaacctacgtaccgaacaacctagtaccctaccgtagtaacgtctaccgtcgtacggtacgacccggaccgacggacctaccgggaccttacgttacgtacgtggttaccgcggtacggttattaccggaacgggtaacgggaaccgtacggtaaccttaacttagtacgttccggtacgggttaccggg

SEQ ID NO: 144781 - DNA, 754 bp, Homo sapiens
  misc_feature: GYAE6OF01A6C0Q.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctctggtggcagcctccagagtcgggccctgtctcgaggtgcagctgacgaggacggtccgggccaggacgtggtagaacgtcccgttcggggaccctcggtccctcaccgtgcgtattcgtttcgtcgtgcctccactcagctaacttagttaacgttggcggtaccgtcgggtcccgaccgaccggaccccaagggaaacgacggaccgtagggaggtagggaggttacggggactacgttacgagttaccgaacggtacccgggaacaccgtaaaccaaccgttaacgaaacgttccccgtaaccctacgaacggtacgtacgacgttaccgaacctacttaacgtaccttaagaacgtaaccgtaaccggttaccaaaccgtaacccgttacgtttaccctacccgttaaggtaacggtaccgtaccgttacgttggacccggaccccgccggtaccggaaccgtaccgggtaccttacgttaacgtacgtcggtcggaccggttacggttatttcccgggaaacgggtaacggtaccggtaacggtaaccttaaacgttataaccggttaccgtacgggttacccgggg

SEQ ID NO: 144782 - DNA, 680 bp, Homo sapiens
  misc_feature: GYAE6OF01CN0ZB.5.23.C01.1.454.CMB.1.raw
  modified_base (385)..(385): a, c, t, g, unknown or other
  misc_feature (385)..(385): n is a, c, g, or t
  modified_base (579)..(579): a, c, t, g, unknown or other
  misc_feature (579)..(579): n is a, c, g, or t
tcagatcagacacgcacgaccggtgctcgatttagtacacgtgattagggattgggcacgaccggtgctcgatttagtacacgtgattagggattggggatacttttctgagactcatggacctcctgcacaagaacatgaaacacctgtggttcctccctcctcctggtggcagcctacccagatcgggcccctgtctcgaggtcgcagctagcgaggacggtccgggcccgaggacgtgggtagaacgtccgttaccggggacccttcggtccctcaccgtgcgtattcgtttccgtcgtcggccttccgatcgacgactacttaatttaggttcggtacgtaccgttcgggtcccgcccgaccgacccccgaagggaaacgngggtaccgtagggagtagggtaggttaggggagtacgttacgtagtcgacggtacccgggactaccaaaccctaaacgtacctaacgtaccccgtacccgtacgaacgtacgtcgaacgtaccaacctataacgttactaacgttacgaacgtaaccgtaccgaactaaccgtacgtcctaccgtagacgtacncgtctcgacgccggcgccgacgccgctactgtaccgtgtcgtacggcgttatacggaaggtacgggactacggtacttaacgtatacgtcgaacgttcggg

SEQ ID NO: 144783 - DNA, 731 bp, Homo sapiens
  misc_feature: GYAE6OF01DVK4I.5.23.C01.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtgttcctcctcctcctggtgcagctccagatgggccctgtctcaggtncagctgcaggagtcgggcccaggactggtgaagccgttcgggaccctgtccctcaccgtgcgatgtttctcgtcggcctcatcagactactattaagttggtacggaccgtcgggtccgtccgaacgcccccgaagggaacgacgggtccgtagggaggtacgggtagttcggggaacgtatcgtacgtaccgaacggttaccgggaacaccgtaacccaaactacctaaaccgtccccgtacccgttacgaaacggtacgttaccgaacgtacccgtaacctaacgttaacttacgttaacgtaaacgtaacccgtaaccgtaaccgtaaacccgtaaaccctaccggtttcccttaccccgttacggtaacggtaccgtacccttccgtacggtaccggaccccgggtaccggtacccgggaaccgtacccggtcccgttagttaccgttacgtcggtacggtccggtaccggtaactttcggaacggtaacgggtacgaacggtacttaacgtataacgtcgtacggttccgg

SEQ ID NO: 144784 - DNA, 628 bp, Homo sapiens
  misc_feature: GYAE6OF01BM6CV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgcccgttcggggaccctggtcccctcaccgtgccgtagttcgtttcgtcgtcggctccatcagcacttattaagttggtggaccgtcgggtcccgccgaccggcccccgaagggaaacgacgggcgtagggacggtggagttcggggagtatcgtagtcgtacgtaccggacgaccaaccaactacaactcccgtaccctacaacgacgtcgacgtaccacctatatactatacgaacctaccgtacgaaaccaaccgtacgttcctacccgtagacggtccgtacctcgtcgtccgaccgccggacggaccgaccggtcctcgtactacgtgtcggccgtcggtacttcggacggaacggaccaagggtacctacgtataccgtgtacggtcggg

SEQ ID NO: 144785 - DNA, 860 bp, Homo sapiens
  misc_feature: GYAE6OF01CHRT1.5.23.C01.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctcctggtggcagctcccagagtcgggccctgtctcaggtgcngctgcgaggngtcgggcccaggactggtgaacgccgttacggggaccctcgtccctctaccgtcgcgtacttcggtttccgtcggtcggccttccgaacgttcacggactaacttaagttaacgttcgggtacggtaccggtcggggtaccccgacccgtaccggacccccgaagggtaaacggacggcggtacgggaggtacgggtagttagggggaacgtacgttaccgtaacgtcgaacggttaacccggggaacgacccgtaaaacccgaaaccgttaaccgtaaaccgttcccccgttaacccgtaaccgtaaacggtacggttaacccggtaacgtacccgtaaaccgtaattaacgttacccgtttaaacgaacggtaaacccgtaaccggtaacccgtaaaacctaaaccccggttaacgttccccgttacccggttaacggtaaccggttaccggtaacctttaccgggttacggtcccggaaccccggggtacccggtcccggggtaaacgtaccccggggttaccttaccggttaaccgtttacgttcgggtcggtacccgggtcggttaacgtttccggaagggttaacccgggaagtaaccggtaacttaacgttaccgttacgtaccggtccggtaccgggg

SEQ ID NO: 144786 - DNA, 583 bp, Homo sapiens
  misc_feature: GYAE6OF01EYMTP.5.23.C01.1.454.CMB.1.raw
  modified_base (428)..(428): a, c, t, g, unknown or other
  misc_feature (428)..(428): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcgggaccctgtccctcacctgcgatgtttctcgtggctccatcagcactattaagttggtggtaccgtcgggtccgccgacgccccaggaacgcggcgtggagtggagttcggggagatctatcgacgtaccggagacaaccaactacactcccgtacctcaagtacgtcgacgtcactatactactaanagacacgtacaaccaacctcgttacctccgtagtaacggtcgaccttctcgtccgacccgcggaccggaccgtaccggccgttactacgttaccgtggtcgtcggtcgttattcgagggacggacgacggtacttactatacgtcgcggtacggg

SEQ ID NO: 144787 - DNA, 718 bp, Homo sapiens
  misc_feature: GYAE6OF01DPF12.5.23.C01.1.454.CMB.1.raw
  modified_base (702)..(702): a, c, t, g, unknown or other
  misc_feature (702)..(702): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctgaggtgcagcgtgcgagggaggtccgggcccaggacgtgggtacgaacgtcccggttaccggggaccctcggtccctccgaccgtcgcgtactgtttccgtcggtgcctccatcgacgctactatttaagttggtcggacgtcgggtccgccgaccgaccccgaagggaacgcggcgtagggagttgggtaggtacggggagtacgtacgtacgtacgacgtaccggggacaccgaaccgaaactaccgtaaccgtcccgtaccacgtaaacggacgtcggtaactccgtaaccgtaataccgttactaacgtaacgaaccgtaaaccgttaccgaaaaccaacccgttacgtttacccgtaccgttaacggaacggttacacccgtacgtcggttaccggacccggtcccggaccggtaaccgaccggtcccgttactaacttcggtcggtcgtacggtaccgtagtttaccggaagggtacggacgtacggtaacttacgtagtacnggtaccggtacggggg

SEQ ID NO: 144788 - DNA, 884 bp, Homo sapiens
  misc_feature: GYAE6OF01CWB8K.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctcctggtggcagctcccagacgtcgggccctgtctcgaggtcgcagctggcgaggaggtccgggacccagggacgtggtacgaacggtcccgttccggggaccctcgtccctcgaccgtgccgtagttcgtttcgtcgtcgtcctcaatccgagctaacttagttaagtcggtcgtaccggtcggtcctaccgaccgtaccccgaaggaaacggtacggtcgtacgggacggtagggtaacggttggggtaactacgttacgtaacgttaccgaacgggtaacccggggaacgtaccgtaaaccctaaaccgttaaccgtaaaccgttcccccggtaacccgtaaacgaacggtaccggttaaccgaccgtaaccgtaacccttaagttactaaccgtttaacgaacggtaaccccgttaaacggtaacccgtaaacccgtaaacccgttacccgttacccgttaaccccggtaaggttaaacccggtcgtaacccgtttccgtaaccgggttaacccggtaccccggacccgggttacccggaaacccggttaccccgggtcctttaacccgtttaaaggtttaccccggtagggttacccggtacccgggttaaccgtttaagggttacccggaaacggggttaacgggtaacccgttaaacggggtaacccttttaacggtaaccgttacggttacccgggtaccgggtttaccggggg

SEQ ID NO: 144789 - DNA, 1047 bp, Homo sapiens
  misc_feature: GYAE6OF01BMQPZ.5.23.C01.1.454.CMB.1.raw
  modified_base (142)..(142): a, c, t, g, unknown or other
  misc_feature (142)..(142): n is a, c, g, or t
  modified_base (329)..(329): a, c, t, g, unknown or other
  misc_feature (329)..(329): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagacatgaacncctgtggttcctcctcctccgtggtggcagctcccagagtgggcccctgtctcaggtgcagctgcgagggacgtcgggcctaggactggtgaacgccgttcggggccctggtccctcgactgcgtatcgtttctacggtggtctccgatcgacgcactagtaagttcggtacggacctggggtcccnccgacggtcccccgtaagggaaacggtacggacgtacgggtaggttacgggtaacggttacgggggaacgttaacgtaccgtttaacgtaaccggttaacggtaacccgggggaacgtaccgtaaacccgtaaaacccgtttaaacgtaaacccgttacccccggttaaccccgttaaccgtaaaaccgggttacgtttaacccgggtaaaccggtttaccccctaaaacccgttaaacggttttaaacgttaacccccgtttaaacggttaacggtaaaccccgtaaaaccggtttaccccgggaaaaacccgtttaaaaccccgtaccgttttttaaaccccggtaacccccggttttaacggggaaacccggggtttttaacccgaacccccgttttaacccggttacccgggttaacccgggtaaccccccggggtaaccccggggtttacccgggggaaacccccggttaaccccggggttaaccccgggtttacccgttttaaaccgggtttttaaccccgttacggggttttaacccgggggtaacccggggttacccgggttaaacccgggttttttcggggaaaaacccgggggttaaacccggggtaaacccgggtttaaaaacccggggttaaccggttaaaccccggtttaaaggtttaacccccgggtttacgggttaacccccggggttttaaacccggggggg

SEQ ID NO: 144790 - DNA, 756 bp, Homo sapiens
  misc_feature: GYAE6OF01DQCS3.5.23.C01.1.454.CMB.1.raw
  modified_base (141)..(141): a, c, t, g, unknown or other
  misc_feature (141)..(141): n is a, c, g, or t
tcagatcagacacgcacgaccggtgctcgatttagtacacgtgattaggattgggcacgaccggtgctcgatttagtacacgtgattagggattgggatactttctgagactcatggacctctgcacaagaacatgaaacncctgtggttcctcctcctcctggtggcagcctccagagtcggccctgtctcgaggtcgcagctgacgaggacgtccggcccaggtacgtggtcgaacgtccgttcgggaccctcgtccctcgaccgtgcgtacgttcgtttccgtcgtcggtccttaccgatcgacgtcctaaccgttagtttaacggttcggtaccggtaccggttcgggtaccccgtacccgtaccggacccccgtaaagggaaaacgcggtacgtacgggtacggtagggtacggtttaggggaactacgttacgtaacgttaccgaacggtacccgggacgtaaccgtaaccgtaaacgtacctaaaccgtcccgtaccgtaacgtaagtacgtaccgtaacgtaaccaccgtaatacgttaactaactaacgaccgtaacgtaccgaaacctacctacgttccgtacccgtagaacgttcgtacctcgtacggtaccgaacccggtcgtaacccggtacgtacccggtaccttacgttaccgttcgccgtacgtacccggtagttacgttaccggaggaacggtaacccgtacgtaaccgttacgttaagtccgtacggtcgtaccgggg

SEQ ID NO: 144791 - DNA, 651 bp, Homo sapiens
  misc_feature: GYAE6OF01AOER3.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccggggcccaggactggtgaacgccgttccggggaccctcgtcccctcacctgcgatcgtttctcgtggctccatcagcactattaagttgggtcggaccgtcgggtcccgccgacggacccccgaagggaacgacggcgtagggagtgggtaggttggggagtacgtacgtatcgacgtaccgggacgaccaacctaactacaacgtcccgtaccctacgaagacgtcgactacacctatactactaagtacgacctacgtacgaaaccaaccgtacgtcccttaccgtacggaacgtcgtacccttcgtgtaccggacccgacccggccggaccgtaccggtaccgtacgttacttcgtcggtcggccggtcggtagttacggaacggacgggtacaacgggtaccttacgtagtacgtcccggtacggttccgggg

SEQ ID NO: 144792 - DNA, 522 bp, Homo sapiens
  misc_feature: GYAE6OF01BKJ3B.5.23.C01.1.454.CMB.1.raw
  modified_base (198)..(198): a, c, t, g, unknown or other
  misc_feature (198)..(198): n is a, c, g, or t
  modified_base (470)..(470): a, c, t, g, unknown or other
  misc_feature (470)..(470): n is a, c, g, or t
  modified_base (479)..(481): a, c, t, g, unknown or other
  misc_feature (479)..(481): n is a, c, g, or t
  modified_base (483)..(483): a, c, t, g, unknown or other
  misc_feature (483)..(483): n is a, c, g, or t
  modified_base (485)..(487): a, c, t, g, unknown or other
  misc_feature (485)..(487): n is a, c, g, or t
  modified_base (489)..(522): a, c, t, g, unknown or other
  misc_feature (489)..(522): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccatttctccctgaaggtgacctctgtgaccgccgcggacacggccgtctattactgtgcgnggtatttcaggagggacaggactactaagtactcgacgtctgggggcaggtacgggaccagggtcagtcgtctcctcacgcctccaccgaggcccagtccggtccttcccccgtggcctacccctcctacccaagtacgccaccgtccgtgggggtaccacgacgcccggcccgtcgggccgtacgccgttcggacgtaacggacgtaccgttcccgtctcgtcgacttcgtcgagggccgtcgtagggccgtaaaggccgacgtagacgtnatggctggnnngngnnngnnnnnnnnnnnnnnnnnnnnnnnnnnnnnnnnnn

SEQ ID NO: 144793 - DNA, 499 bp, Homo sapiens
  misc_feature: GYAE6OF01D3E40.5.23.C01.1.454.CMB.1.raw
  modified_base (466)..(466): a, c, t, g, unknown or other
  misc_feature (466)..(466): n is a, c, g, or t
  modified_base (468)..(499): a, c, t, g, unknown or other
  misc_feature (468)..(499): n is a, c, g, or t
tcagatcagacacgcacgaccggtgctcgatttagtacacgtgattagggattggggagatctatcataccgggagcaccaactacaatccgtccctcaagagtcgagtcaccatatctatagacactcgaacaaccagttctccctgaaggtgacctctgtgaccgccgcgacgacggccgtctattactgtgcgcggtatttcgagagggacaggactactatatcgacgtcgtggggcaggacgggaccacggtcagtcgtctccctcacgccctccaccgaacgggccctacgtccggtccttccccccgtggccctacccctccctaccaagacgccaaccgtcgtggggcaccgaggcccgccgtgggcctcggccgtcggtaccgaagggtacctaccgtttccggtgtctggtactcgtggtacggcggggtctggggacgaacgggtccggtaacgngnnnnnnnnnnnnnnnnnnnnnnnnnnnnnnnn

SEQ ID NO: 144794 - DNA, 748 bp, Homo sapiens
  misc_feature: GYAE6OF01E22XF.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtcgggccctgtctcgaggtgcagctgcgagggacgtccgggaccgagggtacgtgggtacgaacggtcccggttccgggaccctcggtcccctccgaccgtcgcgtacgttcgtttcgtccggtcggtcctccgactcgacgactacttaagttaagttcgggtcggtaccgtcgggtcccgcccgacccggacccccggtaagggaaacggtacgggtcgtagggtacggtacgggtagggttacggggacgtaacgtacgtacgtacgaacggtaccgggtacgaccgtaaccctaaacgtaaccgtaaccgttccgtaccctaagaacggtacgtacgacgtacctaacctatacgttactaagaacgaccgtaaccgtaccgaaacctaaccgtacgttccctaccgtaggtacgtccgtacttcgtacgtccggacccggccggaccggtacgtaccggtccgttacgttacgttacgtcggtaccgtaccggtcgttacgttacggacgggaacggtacgtaacgtaccgttacgtaacgttccgtacgtcgggtacggg

SEQ ID NO: 144795 - DNA, 607 bp, Homo sapiens
  misc_feature: GYAE6OF01D4EUB.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcagggagtccgggcccaggactggtagaacggccgttcggggaccctcgtccctcacctgcgatgtttctcgtgctccatcagctactattaagttggtcggaccgtgggtcccgccacgaccccgaggaacgaggctagggagtgggagttggggagatctatcgacgtaccgggacgaccaaccaaactaccaacgtcccgtaccctacgaagacgtcgagtaccaacctatactactaatacgaccaacgtacaaacctaacctagttacctaccctagaaggtcgtacctcgtcgtacgacccgtaccggacggaccgaccggtccgtacttaacttcgtgtcgcggtcggtattcgaaggacgggacacggtactactaatacgtcgtacgtacggg

SEQ ID NO: 144796 - DNA, 810 bp, Homo sapiens
  misc_feature: GYAE6OF01D8NVF.5.23.C01.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtncagctgcgaggagtccggcccaggactggtgaacgccgttccggggaccctgtcccctcacccgtgcgattcgtttccgtcggtcggcctccactcgacgctactaacgtttaagttgggtcggaccgtcggggtcccgcccgtaccgacccccgaagggtaaacggacgggcgtacgggtaggtacgggtaggtttcgggggaagttacgttaccgttaacgtaccgtaaaccggtacccggggaacgacccgaaaccctaaaaccgtaccgtaaaccgttaccccggtaccccttaacgaaacggtaacggttaccgtaacggtaccctaaccgtaacttaacttacccttaaacgtaaaccgtaaacctacccggtaaccgtaaacccgtaaccccgttacgtttacccttacccgtaggtaaacggtcctacccgttacgtcggtaaccggaccccggtccggaccgggtaccgtacccgggtcccgttacgttaaccgtttccgttacggttaccggcccggttacggttaacggtttaccgaacgggtaacgggtaacgaaccggtaccgttaacctagttaccgttccggtacggtacccgggg

SEQ ID NO: 144797 - DNA, 669 bp, Homo sapiens
  misc_feature: GYAE6OF01A2S0C.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactggtgaagccgttcgggccctgtccctcactgcgatgtttctcgtgctccatcagctacttattaagttcgggtaggtacccgttcggggtcccgcccgaccggtaccccccggaagggaaacgagggtccgtgggacgggtgggtaaggttgggggacgtagttcgtaatccgaacgttaccgggagacccaacctaactaaccaactccccgtaccctacgaacgtacgtaccgacgtccaccgtaattactactaacgtaacgacgtaaccgtaccgaaacctacctacgtttcctacccgttaggaacgttacgtacccgttcgtacggtaccgacccggcccgtaccggaccgtaccggccttcgtattaccgtgtacgcgtacggtatttccgagggacggacgaacggtacctagtaatcgttacggccgttacggg

SEQ ID NO: 144798 - DNA, 729 bp, Homo sapiens
  misc_feature: GYAE6OF01CIT33.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtcggttcctcctcctcctggtggcagcctcccagatcgggccctgtctcaggtgcagctgcaggagtccgggccaggactgatacgaacgtccgttacgggaccctcgtccctcacgtcgcgtattcgttcgtcgtcggtcctccatcagactactaattagttcggtcggaccgttcgggtcccgccgaccggaccccgaagggtaaacggacggcgtcgggtaggtacgggtagttaggggacgtacgttactacgtacgtaacggtaccggaacgaccaaaccgtaacctaaccgtaaccgtacccgttacccaacgtaacggtacgtaccgaacgtccaactaattaactactaagtaacgacccgtaacgtaaccaaacctaccgtacgttccctaccgtaggtaaccgtcgtaccgtacgtcggaccggtacccggcccggtaccggaacccgtccggtacccgttaacgttaccgttacgttacggtacggccgggttacgttaacggttacggaacgggtaacggaaaccgtaccggtaaacttacgttaaacgttcggtaccggtaccggg

SEQ ID NO: 144799 - DNA, 687 bp, Homo sapiens
  misc_feature: GYAE6OF01DF11P.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtcgcagctgcagtaggtccgggcccaggtacgtggtagaacgtcccggtttacggggacccttcgtcccctccgacctgcgtattcgtttctcgtggcctccatcacgtctaactattaagttggtcggtaccgtcgggtcccgccaccggacccccgtaagggaaacgcggtcgtagggtacgtgggaagttggggaacgtagtacgtatacgaacgtaccggggaacactaaccctaaactaccgaacgttcccgtaccctagaacggtacgtacgacgttaccaccgtaatacgtactaacgtaacgacctaacgtacgaaactaacccgtacgttcctacccgtaggacgtacgtaccgtcgtcggaccgtacccggacccggccgtaacgcccggtaccgttaccttagtcgtcgtacgccggtacgtacgttcgaagggaccggacgaacgtccttaactagttacgtccggtcggtaacgggg

SEQ ID NO: 144800 - DNA, 559 bp, Homo sapiens
  misc_feature: GYAE6OF01B9PTY.5.23.C01.1.454.CMB.1.raw
  modified_base (199)..(199): a, c, t, g, unknown or other
  misc_feature (199)..(199): n is a, c, g, or t
  modified_base (492)..(492): a, c, t, g, unknown or other
  misc_feature (492)..(492): n is a, c, g, or t
  modified_base (526)..(526): a, c, t, g, unknown or other
  misc_feature (526)..(526): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtncagctgcaggagtcgggacccaggacgtggtgaacgccgttcggggaccctcgtccctcgacctgcgtactgtttctcggtgctccatcagctatacttaagtggtgaccgtggtccgccacggaccccgaggaaacgcggcgtagggtacggtggagttggggactagtctatcgagtaccgggacacaaccaactacaactccgtacccagacgagtcgacgtaccaactatatactatacgaactacgtacaactacctagttccaccgtagaacgtcactcgtggtacncccggcgacgacgacgtcctctagtactgcgcgngtatggaggcgacagactatactatcgcgtcgg

SEQ ID NO: 144801 - DNA, 511 bp, Homo sapiens
  misc_feature: GYAE6OF01B8VMO.5.23.C01.1.454.CMB.1.raw
  modified_base (471)..(511): a, c, t, g, unknown or other
  misc_feature (471)..(511): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaaacaaccagttctcctgaaggtgacctctgtgaccgccggcggacacggccgtctattactgtgcgcggatttcaggagggacaggactactatatcgacgtcgtggggcaggagggaccacggtcatcgtctcctcaacgcctccaaccgaaacgggcccaagtccggtcccttcccccgtggcccacccctccctaccaagacgccacctcgtcggggcacgacgccggcccgtggccgtcgccgtaggtacgaaacggtaccttaccgttcccgtgtccgtagtactcgtaggacggcggggtacgtgggacgaacgggccgacgtagtaggcagnnnnnnnnnnnnnnnnnnnnnnnnnnnnnnnnnnnnnnnnn

SEQ ID NO: 144802 - DNA, 677 bp, Homo sapiens
  misc_feature: GYAE6OF01CWY9D.5.23.C01.1.454.CMB.1.raw
  modified_base (410)..(410): a, c, t, g, unknown or other
  misc_feature (410)..(410): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtggttcctcctcctccgtggtggcagctcccagactcgggccctgtctcgaggtcgcagctcggcgagggtacggtccggggcccagggtacgtgggtgaacgtccggttccgggggaccctcgtcccgtcaccgtgcgtattcgtttccgtcggtcggctccatcgacgactacttagttaagttgggtcggtaccggtcgggtccgacccaccggaccccggaaggaacggacggtcgtagggaggtgggacggtgggganagtctagtcgaacgtaccgggacaccgaaccaacgtactaaccgtcccgtaccacgtaacgacgtacgtactaccacgtaactactactagacgaacgtaccgtacgaaacctaaccgtaccgttccttacccgtaggtaacggtcgtacctcgtacggtccgaccggtcccggacggaccgaccggtccttacgtacgttacgtcggtacgcggtacggtactttacggaggacggtacgagtactactattacgtcggcgtcggg

SEQ ID NO: 144803 - DNA, 775 bp, Homo sapiens
  misc_feature: GYAE6OF01CV6NC.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatcggacctcctgcacaagaacatagaaacacctgtggttcctcctcctccgtggtggcagctcccagagtcgggccctgtctcgaggtgcagctcgcgaggacgtccggggccaggtacgtgggtacgaacggtcccggttccggggaccctcgtccctcgtacctgcgtagttcgtttcgtcggtcgcctccatcacgactactagttaaggttcgggtcggtaccggtcggtcccgacccgaccggaccccgaagggaacggacgggtcgtagggacggtagggtacgggtaggggtactacgttacgtaacgtacggtaaccggtaaccgggtaacgtacccgaaacccttaaaccgtaacccgtaaccgttacccccggttaacccaacgggtaaacggtcggttaaccgtaaccggtacctaaccgttaattaacttaaccgtaacgtaacgtaaccgtacccgtaacccgaaaaccctaaacccgttacgttacccctacccggtaaggtaaccggtaccgtacccgttcgtacggtaccggaccccgggtccggaccggtacccggcgttaccgtagttactacggtcgtcggccggtacggtacttacggagggaccggtacaggtacctaagtctacgcggtacgtcggg

SEQ ID NO: 144804 - DNA, 718 bp, Homo sapiens
  misc_feature: GYAE6OF01EK7Y8.5.23.C01.1.454.CMB.1.raw
  modified_base (344)..(344): a, c, t, g, unknown or other
  misc_feature (344)..(344): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcggcccaggactgggtgaacgccgttcggggaccctcgtccctcacctgcgtatcgtttctcgtggctccatcagcactatttaagttggtcggaccgtggggtcccgccgtacggcccccgagggaaacgnggcgtggacgtggagttgggganagtcgtatcgagtaccggganaccgaacaacgtaccaacgttcccgtaccctacaacggtacgtaccgacgttacccaaccagttactacctaataacgaccgtaaccgtaccggaaacctaaccgtacgtttacctacccgtaggtaacggttcgacccgtttcgtacggtaccggaaccccgggtcccggaccgggtaacccgacccggggtacccgttacgttaacgttaaccggttcgggtaccggtccgggtaacggttacgttttacggaacggggtaacgggaaccggaacgggttaaccgttaaaccgttagttaaccgttaccggtacggtttacccggggg

SEQ ID NO: 144805 - DNA, 749 bp, Homo sapiens
  misc_feature: GYAE6OF01CA995.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctcctggtggcagctcccagagtcgggccctgtctcgaggtgcagctgcgagggacggtccgggcccgaggacgtgggtacgaacggtcccggttaccggggtaccctcggtcccctccaccgtgcgtatttcgtttccgtcggtcggtcctcctactcacgtactacgttaatttaaggttcgggtcggtacccggttcgggtccccggacccgaacccggacccccggaagggaaaacggacgggtccggtagggtacgggtacgggtagggttaggggaacgtactacgttaacgtacgtaaccggtaaccggggaacgtaacccgtaaaccgtaaacgtaacctaaccgtacccgtacccgtaacgaacgtacgtacgacgtaccactatactactaacgtacgacgaccgtacgaacctaaccgtacgttacctaccgtaagtacggtaccgtaccgtcgtacggtaccgacccgtccggaccggaccgtaccggtcccgttactaccttacgtcgtccggacggtcgtacttacggacggaacggtacgaacggtactaactagtacgtccggtacgtcggg

SEQ ID NO: 144806 - DNA, 736 bp, Homo sapiens
  misc_feature: GYAE6OF01CKBUS.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtgggccctgtctcaggtgcagctgcgaggagtccgggcccaggactggtgaacgccgttcgggaccctgtccctcacctgcgtattcgtttcgtcgtcggctccatcagtactactattaagttggtcggaccgtcgggtccgacccgacgacccccgaaggaacgacggcgtaggaggtggagtaggggagtacgtcgtaatcgaacgtacgggacaccgaaccaactaactaacgtcccgtaccctacgaacgacgtaccgtaacgtaccgaacctaacttaacgtacctaacgtaacgtaaccgtaaccgtaacccgaaaacctaaacccgtacgtttaccctaccccgttaggaaacgggtccgtaacccgttcgttacggtaccgggaccccggcccgggtaccgggaacccgtaacccgggtcccgttacgttaacgttaccgttacgggtcgtaccgggtaccgggttagtttaccggaagggtaacgggaccgtaaacgggtaaccttaaaccgtaagttaaccggtccggtaacggttaccgggg

SEQ ID NO: 144807 - DNA, 723 bp, Homo sapiens
  misc_feature: GYAE6OF01C3AVN.5.23.C01.1.454.CMB.1.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
  modified_base (375)..(375): a, c, t, g, unknown or other
  misc_feature (375)..(375): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtgggccctgtctcaggtgcagctgcgaggagtcgggcccaggactggtcgaagtccgttcggggaccctcgtccctcacctgcgtatgtttcncgtcggctccgatcagtcacttattaagttggtacgaccgtcgggtccgccaccggcccccgaaggaacgnggaccgtggacggtagggtagtggggaanacgttactagtaccgtaacgtacccgggaacgaccgaaacctaaaccgtaaccgttaaaccgtccccggttaccctaacgaaacggttacggtaaccgtaacgtacccaaaccgtaattaaccttacgttaacgttaaacgaaccgtaaccggtaccgtaaaacccgtaacccgttacggtttaccctaccccgttaggaaacggttcctaaccgttcgtacggttacggacccggtccggaccggaccgtaccggtccgtacgtttactaacgtcgtcgcggtacgtatttacggaaggtaaccggacgaaggtaccttaacgttatacgtcggtaccggtaccggg

SEQ ID NO: 144808 - DNA, 738 bp, Homo sapiens
  misc_feature: GYAE6OF01CIPLL.5.23.C01.1.454.CMB.1.raw
  modified_base (665)..(665): a, c, t, g, unknown or other
  misc_feature (665)..(665): n is a, c, g, or t
tcagatcagacacgcacgaccggtgctcgatttagtacacgtgattagggattgggcacgaccggtgctcgatttagtacacgtgattagggattggggatactttctgagactcatggacctcctgcaacaagaacatagaaacacctgtcggttcctcctcctccgtggtcggcacgcctcccgagacgtcgggccctgtcctcgaggtgcagctgacgaggacgtccgggccgaggtacgtaggagaacgtccgttccgggacccttcggtcccctcgaccgtgaccgtagttcggtttcgtcggtcgcctaccgacgtccacgtcctaacgttatttaaggtcgggtacgtaccggtcggtcccgaccgacccgaacccggaaggtaaacggcggtacggtagggaggtacggtaggtacggggatacgtatacgacggaacggtacgggaacaccggaacctaacgtaaccaacgtaccccgtactaacgaaggtaccgtacgaactccgaactattaactaacgtacgtaacgtaaccgtacggtaccaaaaccgtaccgttaccgtttcctaaccggtaggtaaggtacctccgttacggtacggaccggtacccggcccggacggtaccgacccgggtacttacgtaagtttcccgngggtcgtaccggtacggttatacggagggaccgaatacggtactaacgtacggtcgtaaccggtggtaacggg

SEQ ID NO: 144809 - DNA, 836 bp, Homo sapiens
  misc_feature: GYAE6OF01CNQB4.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtcgttccctcctcctccgtggtgcagctccagacgtcgggccctgtcctcgaggtgccagtctgacgagggacgtccgggaccgaggacgtggtaggaacggtccggttccgggacccttcgtcccctcgaccgtggtaccgtacgttttcgtttccgtcggttacggtccctaccacgtacacgtacctacttaacgtttagttcgggtaccggtaccggttcgggtacccgacccgtaaccggaccccggtaaggaaacggtacgggtccggtagggtacggggtagggtaagggttacgggggaacgttacttaccgtaagttacccggaacggtaaccgggtaacgtaacccaaacccgtaaacgtaaccgtaaacccgttacccggttacccaacggtaacgtaccgggttaccgtaacccggttaaccaccttaaacgtactttaaccgtaaacgttaaccggaaaccttaacccgggttaaccaaacccgttaaaccgttccgtttacccgtaccccgtaaggtacccgtaccgttacgttaccggtacgtcccggaacccggccggtaccggaaccttacccgggtcttaccgaactttcggtaccgtcggtacgtacggtacgttacggaaggtaccggaacttacggtaccttacgtagttcgacgtcgggtacggg

SEQ ID NO: 144810 - DNA, 785 bp, Homo sapiens
  misc_feature: GYAE6OF01BSBOO.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactgggtagaacggtcccgttcggggaccctcgtccctcacctgcgtatcgttctcgtcggtctccatcagctacttattaagttggtacggtaccgtcggggtcccgccgaccgacccccgaagggaaacggacgggccgttagggaggttcgggtagttagggggactacgtcgttaagttccgaacgttaccggggaacgacccgaaaccgtaaacctaaccgtaaccttaccccggtacccctacgaacggtacggtacggacgtacccgaactaattacgtaccttaatacggaaacctaccgggtaaccaaacctaacccgtacgtttccctcccgttaggaaacgggttcaacccgttcgtacggtacggtaccccgggacccgggaccggtaccgaacccgggtcccgttaacttacccggtttaaccggtgggttaccgggtacccgggtcggggtttaacctttaccgggtaaccggggaaaccggggtaacccgtaaacgggttaaccttaccgttaaagtaccggttacgggtaccccggtttacggggg

SEQ ID NO: 144811 - DNA, 715 bp, Homo sapiens
  misc_feature: GYAE6OF01CUDSI.5.23.C01.1.454.CMB.1.raw
  modified_base (323)..(323): a, c, t, g, unknown or other
  misc_feature (323)..(323): n is a, c, g, or t
tcagatcagacacgcacgaccggtgctcgatttagtacacgtgattagggattgggcacgaccggtgctcgatttagtacacgtgattagggattggggatactttctgagactcatcggacctcctgcaacaaagaacatagaaactacctgtcggttccctcctcctccgtggtcggcacgcctcccgaagcgtcgggccctgtctacaggtcgcgacgctcgcgagggacggtccgggccgaggacgtgggtagacggtcccggtcggggacccttcgtcccctacgacctgtcgtattcgttcgcggtgctccatcganctaactagttaacgttcggcgtaccgtcggtcccgaccgaccggacccggaaggaaaggtcggtacgacgggtaggtagggaaggttagggactactagtacgacgtaacggaccgagaaccaacgtaactacgacgtccctaacgtcaacgtccgtagacctaacgacctaagtactaacgtagtaaccgaacgtaaaccggtaaccaaccgtaactacgttccaccgtaggtacggactcttacggaccgggtaccgacccggtaccaaccgggtacctacccggaccttacgtaacttcggacggtccggaccggtacgttaccgaggaaaccggggataaacccgggtagtaaacccttagtaaccgtcggcggtaacggtccggggg

SEQ ID NO: 144812 - DNA, 737 bp, Homo sapiens
  misc_feature: GYAE6OF01C3WMQ.5.23.C01.1.454.CMB.1.raw
  modified_base (184)..(184): a, c, t, g, unknown or other
  misc_feature (184)..(184): n is a, c, g, or t
tcagatcagacacgcacgaccggtgctcgatttagtacacgtgattagggattgggcacgaccggtgctcgatttagtacacgtgattagggattggggatactttctgagactcatggaccctcctgcacaagaacatagaaacacctgtcggttcctcctcctcctggtggcagctcccagntgggccctgtctcaggtgcagctgcgaggacggtccgggcccgtaggaccgttgggtcgaaccggtcccggtttccggggacccttcgtcccctctaccgtgtcgtattcgttcgtcgtcgcctccatcacgactacttagttaagttgggtacgtaccggtcggtccgacccgaccgaccccgaaggaacgaggcgtacggagtgggtaggtgggagtatactatacgacgtacggacacaaccaactactactccgtacctacgaacgtcgtacgtacgtaccacgtataacttatacgtaacgaaccgtaaccgtacgtaaaccaaccgttacttacccgtaccgtaacgtacggtccgtaccgttacgtcgttacccggacccggtccggaccggtaacccgacccggtaccgttacgttaccgttaccgtacgggttcggaccgggtccggttaagttaccggaaacggggtaaccgggtaaccggtaaggttaaacccttaaacggttaacgtttaccggtaccgggtacccggtttaaccgggggg

SEQ ID NO: 144813 - DNA, 724 bp, Homo sapiens
  misc_feature: GYAE6OF01D49MD.5.23.C01.1.454.CMB.1.raw
  modified_base (201)..(201): a, c, t, g, unknown or other
  misc_feature (201)..(201): n is a, c, g, or t
  modified_base (359)..(359): a, c, t, g, unknown or other
  misc_feature (359)..(359): n is a, c, g, or t
  modified_base (428)..(428): a, c, t, g, unknown or other
  misc_feature (428)..(428): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtgttcctcctcctcctggtggcagctcccagagtcgggccctgtctcgaggtncgagctgcgagggacgtccgggaccaggacgtggtaggaacgtcccggttaccgggacccttcgtcccctacgaccgttcgcgtacgttcgtttcgtcggtcggcctccactcgacgtctacgttaattaacggttggtacggtaccgtcgggtcccnccgtaaccgacccgaagggaacgtacgccggtagggtagtagggtaggttaggggactacgttcgttanaccggaacggtacggacgaccaaacctaactacctaccgtcccgtacctaacgtaagtacggtacgaccttacaacctatacgtactaagtaaccaacgtaccgtaaccgaaactaccgttcttccgtacctaggtaacgtccaacgttcgtacggaccgacccggtacccgacgtaaccgtccggtaccgttacgtacgttcggtcgtaccggtaccggttacgtacgttacggagggaaaccggtaataccgggttaactaacgttaaccgacgttccgggtcggttaacgggg

SEQ ID NO: 144814 - DNA, 874 bp, Homo sapiens
  misc_feature: GYAE6OF01DSRY2.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtgggccctgtctcgacggtcgcagctgcgagggacggtccggggcccgaaggtaccgtagggtaggacggtcccgtttccgggggaccccttcggttcccctacgacccgtgtaccggtactttcgggttttccgtcgggttcggacccttccgtactacgtacggtaccttaaccgttaagttttaacggttacggggttaccgggtaacccggttccgggggttcccgacccgaacccggtacccccggaaaggggaaacggtacgggtccggtacggggtaggttacgggtaaggtttacgggggaagtacttaccgtaacgttacgtaacggtaaccggggactaacccaaccgtaaacctaactaacccgttcccgaccctaacgtaaacgtaccgtaccggtaactacccgtaaacctaacgtaccgttaactaataacggaacccgtaccggtaacccgaaacctaaacccgttaccgtttacccgtaccccggtaaggtaaccggggttaccctaaccggttaccgtacgggttaccggacccccgggtccgggaaaccggtaccccggtacccggtacccgttaccttacgttacgtcggttaccggacggtaccggttacgtttacgaaccggggtacggaagtaacgggtactaacggtataaccggtgtaccgtacgggg

SEQ ID NO: 144815 - DNA, 904 bp, Homo sapiens
  misc_feature: GYAE6OF01EXK42.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagcctcccagagtgggccctgtctcaggtgcagctgcgaggaggtccgggcccaggacgtggtagaacgtcccgttccgggaccctcgtcccctccgaccgtcggcgtattcgtttccgtcgtcggtcctccgatcgacgtacctaacttaacgttttaagtttcggggttacggtacccgttccggggtacccccgacccgaacccggacccccccggtaaagggaaaacggtacgggtaccgttaggggtaacggttagggtaaggtttacgggggaagtaacgttacgtaacgtaccgtaacggtaacccggggacgaaccccgtaacccgtaaaaccgttaacccgtaaacccgtttcccccgtaaccccgttaaacggtaaaccggtaccggtaccgtaacggtaccctaacccgtaagttaaccgttacgtaaacgtaacggaacccgtaaaccggtaacccggaaaacccttaaaccccgttaccggttttacccctaacccggtacggtaaacgggttaccgtaaccccgtttcggttaccggtacccgggaccccggacccgggtacccggtaacccgtacccgggttaccccgttaacgtttaacgttaacccgttacggtccgggtacccgggtccggttaagtttacgggaaccgggtaacggggtaaaccgacgggtaaaccttaaccgttaaggtaacgttaccggtacggttaccgggg

SEQ ID NO: 144816 - DNA, 1173 bp, Homo sapiens
  misc_feature: GYAE6OF01CLS15.5.23.C01.1.454.CMB.1.raw
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (202)..(202): a, c, t, g, unknown or other
  misc_feature (202)..(202): n is a, c, g, or t
  modified_base (1141)..(1141): a, c, t, g, unknown or other
  misc_feature (1141)..(1141): n is a, c, g, or t
tcagatcagacacgcacgaccggtgctcgatttagtacacgtgattagggattgggcacgaccggtgctcgatttagtacacgtgatttagggattggggatactttctgagactcatggacctcctgcaacaagaacatagaaacaccttgtggttcctcctccctcgtggtgcncncctacgagtgtccgtctgtctagnggtcgacgcgtcgcggacggacggtaccgggtcccggaccgtacgggtacggtagggtaaccggtaaccggttcccggggttaccccgggtacccgttcccgttacccgtacccgtaccggtacggtacgtttaccggttttaccggtttccggtcccgggtcggttaccccttaaccgtacgtacccggtaacttaaccgtttaacgttttaaacggtttacgggggtttaccgggggtttaccggtaaccccgggggtttccccgggtaccccgaaacccgggtaaaccccccgggtaacgggtaaaaacggggtaaacgggttccgggtacggggtaacgggttagggtaacggggtttacggggtaacggggttaaccttcgtttaaacggttaaccggtaaccggggtaaccggtaaccggggtaacctaaaacccggttaaaccctaacccgtttaacccgtaaccccggttaccccggtaaccctaaacgggtaaccggttttacccgggaaacccgtaacccgttaaaccctaaaccggttttaaagtttaaaccccgtaccggtttaaagaaccccgtaaaccccgggtttaaacccgtaaaaccgtaaaaccccggttacccgtttaaccggttacccccgtttaaggggtaaaccgggttaaccggttacccctaacggggttttaacccggtaccggggtaaccccccgggaaccccggggttaacggggaccccttaaacccggggggttttccccggttaacgttttaaacccgttaaccggttttacccggggtccggggttaacccggggtttaaccgttaaacccgggttttaagggaacccgggggttaaaggggggaaaccccggtttaaaacccgttaacgggtttaaccttaaaccccttaaccggggggttttaccncccggggggggttttaaaacgtcccggggggg

SEQ ID NO: 144817 - DNA, 881 bp, Homo sapiens
  misc_feature: GYAE6OF01DHYYU.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcgatcggacctcctgcacaagacatagaacacctgtcgttcctcctcctcctggtggcacgcctcccgaagcgtcgggtccctgtcgtcgtagggtgccaggtctcggaccgagggtacggtcccgggacccgagggtacgtggtcgaaccggtccgttaccgggggtaccccttcgtacccctcgaccgtggtcgtacgttcggtttccacggtccggccttaccgtactaccgacgactaaccgttagtttaagttcgggtacggtacccgtcggggtcccgtccgtaaccgtaccccgaaaggggtaaaccggacgggtccgtaacggggaccgtaaggggtacggtttacgggggactacgtttcgtaaaggtcccgtaaacgggtacccgggaagaacccaacccgtaaacgttacccgttaactacccccggttacctacggaaacggtacggtaacccggtacccgtaccgaaccgttaataccgttacgttaaccgtaaacggtaacccgtaccggttaaaccccggaacctaaacccgttaccgtttacccgtaccccgtaaggtaacccggtcgttaccgttaccgtacgggttaccggaccccggcccggtaccgggtaacctcccggggtccttaaccggtttagttacccggtaggtcccgggaaccggttcgtaacggtttacggaaacggtaccggttaacgaaaccgtaccttaaacgggttactaccggtcccgtacggggttacccggg

SEQ ID NO: 144818 - DNA, 737 bp, Homo sapiens
  misc_feature: GYAE6OF01A0G3T.5.23.C01.1.454.CMB.1.raw
  modified_base (145)..(145): a, c, t, g, unknown or other
  misc_feature (145)..(145): n is a, c, g, or t
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
  modified_base (516)..(516): a, c, t, g, unknown or other
  misc_feature (516)..(516): n is a, c, g, or t
  modified_base (660)..(660): a, c, t, g, unknown or other
  misc_feature (660)..(660): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatcgaaacncctgtgtcctcctcctctggtgcagcctccgagngtcgggccctgtctgacggtncgagtcgtggcgaggcggtccgggaccaggtacgtggtagaccgtccggttccggaccctcgtccctcgaccgtcgcgtagttcgtttcgtcgtcggcctcctatccgacgtcttaacgttagtttagttgggtaccgtaccgtcgggtcccacccgaccggaccccgtaggaacggtcggcgtagggacgtagggtaggttagggtacgtacgttcgtaacgtacggtaacggtaccggaaccgtaccaaacccgtaacctaaccgtacctccccgtaccctacgaacggtacggtaccgacgtaccaaacgttnttaacgtactacgaactaccggaaccgtaacccgaaccgtaacctaccgtttacccgaccgttagtaacggttccgacgttaccgagggtacccgacccggcccgggtaccgtaacggcccgtccgtttaacgtcgttaccggngtaccggtacggtcgttaccgtaggtaacgggaaccgtacgacgttaccgtactaacgacgttccggacggtacggg

SEQ ID NO: 144819 - DNA, 891 bp, Homo sapiens
  misc_feature: GYAE6OF01DDNKH.5.23.C01.1.454.CMB.1.raw
  modified_base (273)..(273): a, c, t, g, unknown or other
  misc_feature (273)..(273): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtggttcctcctcctccgtggtggcagctcccagagtgggccctgtctcaggtgcagctggcgagggcggtccgggaccacggacggtcggtggaacggtaccgttcgggtacccggtctccgtccnccgtagcgtagtcgttttcgtcgtcgggtcctccactctacgactaacttaagtttaatttaggggtcggtaccgggtaccggggttccggaccccgtaccgacccccggaacgggtaaacggggaacgggcggttcggggttagggtaaggggtagggttagggggtaacgagttacgttaactaccggtagtaacccggggtaacgaccgaaacccctaaaccgtaaccttaacctaccccgttcccgtaaccggtaaggaaccggttcgggaacgttccctaaacctaactttaaacgtaccttaacggtaaacgtaaacccgggtacccgttaacccgggaaaaccctaaacccgtttaaaccgttcccggttttaaccccgtaaggttaaccgggttaacgtaccgtttcccgttaggtacccgggttaccccgacccgggtacccgggaacccggtacccggggttcccggttaacgttaccgtttaacgggtccggtttaccgggaccgggtccggtttaacggtttaccgggtaaggggaacccgggtaacggtaacggtaaccgttaaggttaccgttaaacggtccggttacgggttaaacccggggg

SEQ ID NO: 144820 - DNA, 647 bp, Homo sapiens
  misc_feature: GYAE6OF01CZJ0H.5.23.C01.1.454.CMB.1.raw
  modified_base (353)..(353): a, c, t, g, unknown or other
  misc_feature (353)..(353): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcgggaccctgtccctcacctgcgtatgtttctcgtggctccatcagcactattaagttggtggacctgggtccgccgacgccccgaaggaacgaggcgtggagtggagttgggganagtctatcgagtaccgggagacaaccaactacaactcccgtccctacaagacgtcgacgtccaacctatactactaagtacgaacctacgtacgaaacctaacccgtacgttacctacccgtaggtaacggtcgtacccgttctcggtacgacccgggtccggaccggaaccgtaccgggtaccgttccttaaacgttcctcggtggaccggtaccgggttacgttttacggaacgggtaacgggaacgaacgggtaacgttaacctattaacgtccggtacggttacccgggg

SEQ ID NO: 144821 - DNA, 595 bp, Homo sapiens
  misc_feature: GYAE6OF01BLB16.5.23.C01.1.454.CMB.1.raw
  modified_base (373)..(373): a, c, t, g, unknown or other
  misc_feature (373)..(373): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtgttcctcctcctcctggtggcagctcccagatcgggccctgtctcaggtgcagctgcagggcgtcgggcccaggactggtgaacgtcccgttccggggaccctgtcccctcaccgtgcgtattcgtttctccgtggcctccatcagctactattaagttggtcggtaccgtcgggtcccgccgacgacccccgaggaagacggcgtaggagtggagttgggganatcgtatcgacgacgggacgaccaacctaactacactcccgtaccctacgacgtacgtcgacgtccactagtactactagacgactacgtacaaccaacgtacttcctcctagacgtctaccgtcgtcgtacgccgaccgaccgacgccgtactctacgtactgtcgtcggacgttattcggaggacggaacgacggtactactagtactcgtacggtcggg

SEQ ID NO: 144822 - DNA, 604 bp, Homo sapiens
  misc_feature: GYAE6OF01BMSUA.5.23.C01.1.454.CMB.1.raw
  modified_base (233)..(233): a, c, t, g, unknown or other
  misc_feature (233)..(233): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagcctcccagatcgggccctgtctcgaggtgcagctgcgaggagtccgggcccaggactggngaacgtccgttcgggaccctgtccctcacctgcgtatcgtttctcggtcgcctccatacagcctacttaatttaagttggtcggtaccgttcgggtcccgccgacgcccccgaaggaaagacggcgtacgggagtaggtaggttacgggagtagtactagtactacggtaccggagcctaaccgactaactactccgtaccctacgagtacgtacgactcacatactactaatacgactacggtacaacgtacctagttaccaccgtagacgtcgactcgtgtacgacccggcgacgacgaccgtctagtactacgtgtcgcgtcgtattacggagacggagtacgtactactatacgtcgtcggtacggg

SEQ ID NO: 144823 - DNA, 126 bp, Homo sapiens
  misc_feature: GYAE6OF01DNT9W.5.23.C01.1.454.CMB.1.raw
  modified_base (121)..(126): a, c, t, g, unknown or other
  misc_feature (121)..(126): n is a, c, g, or t
tcagatcagacacgcacgaccggtgctcgatttagtacacgtgattagggattgggcacgaccggtgctcgatttagtacacgtgattagggattggggatactttctgagactcatcggnnnnnn

SEQ ID NO: 144824 - DNA, 743 bp, Homo sapiens
  misc_feature: GYAE6OF01CR2G4.5.23.C01.1.454.CMB.1.raw
  modified_base (417)..(417): a, c, t, g, unknown or other
  misc_feature (417)..(417): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctccagatgggccctgtctcgaggtgcagctgcaggagtcgggccaggactggagacgtccgttccgggacctcgtccctcacctgcgtattgttctcgtcggctccatcacgactactagttaacgttggtcggtaccgtcgggtcccgccgaccgacccccgaagggaaacggtcggcgtagggaggtacggtagggttaggggactagttacgtacgtaccgtaacggtaacccggggaanaccctaaaccgtaaaccgttaacctaaaccgttccccgtacccctaacgtaaacggtacgtacgaacgttacccaaccttaacttaacttaccttaacgtaacgtaacccgaccgttaaccgaaaacccgtaacccgttacgtttccctaccgtaggtaaccggtaccgtaccgttcgtacggtaccgtaccccgggcgaccggtaccgaccggtccttacgttcgttaccgtcgtacggtcggtcgttagtttaccggacgggtaacgggtaaccgtaacggtaccgttaacgttacgttaacggttcgtaaccgggttacgggg

SEQ ID NO: 144825 - DNA, 709 bp, Homo sapiens
  misc_feature: GYAE6OF01ECYWU.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctggtctcaggtgcgagctcggtaggagtcgggcccgagggaccgtgggtgaacgtccgttacggggacccctgtccctacaccctgcgtatgtttcctacggtcggcctccagtcagctaacttattaagttgggtcggaaccgttcggggtcccgtaccgaccggacccccgaaggtaaacggaggtacgtggaggtcggtagttaggggacgagtacgtacgtactaacggtaccgggagtacctaaccgaacctaacaacgttcccgtacccctaacgaaggacgtacgacgtacaacccgaatacttacgtaactaacggaacaacggtaaccaaaccgtaacctacggttacctacccgtagtaacggttcgtaccgtcgtaacgtacggaacccggtccggaccggaccgtaccgggacgtccttaacgttacgtaggtcggaggtccggtaagtttacgacgggtaacgggaactacggaaccttactaagttacctacggcgtcggtacgggg

SEQ ID NO: 144826 - DNA, 858 bp, Homo sapiens
  misc_feature: GYAE6OF01B9S13.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtgggccctgtcgtcaggtgcagctgcgaggacggtccgggcccgaggacgtggtagaacggtcccgttccggggaccctcgtccctccgaccgtgcgtacgttcggtttccgtcggtcggtcctaccgtactccgagcctaacttacgtttaaggttcggtacggtaccggttcgggtcccgacccgtacccggacccccggaagggtaaacggacgggtacggttacggggtaggtacgggtaacgggtttaggggaacgttacgttaccgttaacgttaccggtaacgggtaacccggggaactacccgtaaaaccccgtaacgttaaaccgtaacccgttccccgttaaccccgtacgtaaacggttaccggtaccgtaacgttaccctaacctaacgttacttacctaaacgtaacgaaccgtaaacccgtaaccgaaaacccttaaccgtaccggtttacccgtacccgttagggtaaccggtccgtaacccgttcgttaaccggtcccggacccggtcccgggtaacccggacccgtaacccggttcccgttacgttaccgtttacggtcggtaccggtccgggttcgttaacgtttaccggaagggtaaccgggtaccgtaacggtacctttaaccgtaagtaaccggttccggtacggttacccgggg

SEQ ID NO: 144827 - DNA, 792 bp, Homo sapiens
  misc_feature: GYAE6OF01ASDUO.5.23.C01.1.454.CMB.1.raw
  modified_base (181)..(181): a, c, t, g, unknown or other
  misc_feature (181)..(181): n is a, c, g, or t
tcagatcagacacgcacgaccggtgctcgatttagtacacgtgattagggagttgggcgacgaccggtgctcgatttagtacacgtgattagggattgggatactttctgagactcatggacctcctgcacaagaacatgaaacacctgtgttcctcctcctcctggtggcagctcccagngtcggccctgtctcgaggtgcgagcgtgccgagggacggtccgggacccgagggtaccgtgggtacgaacggtcccgttcccgggggaccctcggtacccccgtaccgtacccgttggtaccggtacgttcggttttccgtccggttcgggcccttcccgtacgttacccgtacggaccctaacgttacgttttaaacggtttcgggtacggggtaacccgtttccggggtacccccgacccggtaccggtaccccccggaagggaaaacggtcgggtacgtggggtaacggtacgggtacgttcgggggactaacggtcttaacgtcgaacggtaccgggacgaccgtaacccgaactaaccgtaaacgttccccgtacccgtacaaggtacgtacgtacgtaccgtaactactactacgtacgtacgaaccgtaccgtaaccgaaccgaaccgtacgttacccgtaccgtacgtaacgtcgttaacgtccgtacgtaccgacccgtaccgtacggtaccgaccgtaccgttacgtactacgttcgtcgtacggtcgtacgttacgacggacggaacgacgtactacgttaacacgtttcgcggttacgg

SEQ ID NO: 144828 - DNA, 754 bp, Homo sapiens
  misc_feature: GYAE6OF01BWHQC.5.23.C01.1.454.CMB.1.raw
  modified_base (145)..(145): a, c, t, g, unknown or other
  misc_feature (145)..(145): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatagaaacncctgtcggttcctcctcctccgtggtcggcagcctcccagacgtcgggccctgtctcgaggtgcagctgcgagggacggtccgggccaggtacgtggtagacggtccggttcgggacctcgtccctacacgtgcgtattcgttcgcgtcgcctccatacgacgtactaactagttaacggttcgggtacgtaccggtccggtccgaccgaccggaccccgaagggaacgcggacggtaggtacggtaggtaggtagggatacgtacgtaacgtcgaacggtaccggactaccgaaccgtaacgtaacctaccgtacccgttaccaacgaacggtacgtaccgaacgtaccaactaacgttactacgttaacgaacgtaccgtaaaccggtaaccaaacccgtaacgttacccgttaaccgtacccgtaagggtaaccggttaccgtacccgttacgtaccgggtacccgaacccgggcccggtaacccgggtaccgtacccggtaccgttaccgttacgttacggtcggaccggtcggtaccggttaattccgggaaggtaccggtacgtaaccgtacgtaacttacgtacgtaccgggtacgtcgggg

SEQ ID NO: 144829 - DNA, 929 bp, Homo sapiens
  misc_feature: GYAE6OF01DUO4E.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctcctggtggcagctccagactgggccctgtctcaggtcgcagctgcaggacgtccgggcccaggacgtggtagaacgtcccgttcggggaccctcgtccctcgaccgtgtcgtagttcgtttccgtaccggttcggtcctacccgtataccgacgtacctaacgtttaacgtttaacggttggggtaccgggtaacccgtttcggggtaccccgacccgtaacccggaccccccgtaaaggggaaacggtacgggtccgtagggacggttagggtacggttacggggaagttacgtacgttaacgtaccgtaaccgtaccggggtacgtaacccgaaccgttaaacctacgtaaacccgtccccggttaaccgtaccggtaaaacggtacggtaaccggtaaccggttaccctaaacccgttacgttaacttacccgtttaaacgtaaccggtaaccgtaaccgggtaaacccttaaaccggtaaacccgttaccggtttaccccgttacccgtaaccggggtttaacgggttaacccgtacccggttttaaccgtacggggttaacccgggtaaccccgggtacccgggtaacccggtaaacccgggtacccgggtttacccggttaccgtttaaccggttaaccggttacggttaccgggtaccgggttacggttaacgttttaccgggaaagggttacccggtaacggtaacccggttaaccgttaacgtacgttaaccgggtccgtaccgggttaaccggggg

SEQ ID NO: 144830 - DNA, 702 bp, Homo sapiens
  misc_feature: GYAE6OF01DYAGP.5.23.C01.1.454.CMB.1.raw
  modified_base (180)..(180): a, c, t, g, unknown or other
  misc_feature (180)..(180): n is a, c, g, or t
  modified_base (345)..(345): a, c, t, g, unknown or other
  misc_feature (345)..(345): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagctcccagntgggccctgtctcaggtgcagctgcgaggagtccggcccaggactggtgacgtcccgttccgggaccctgtccctcaccgtgccgtattcgtttccgtcgtcggcctccatcagctactattaagtggtcgacgtcggtccgccgaccgtaccccgaaggaacgnggcgtaggaggtacggagttgggacgtatcgtagtcgaacgtaccggacgaaccgaacctaacgtacaacgttcccgtaccctacgaacgtacggtcgaacgtaccaacctaatacttactaagttaaccgacgtaaccgtaccgtaaaccgtaaccccttagttcccctaaccgtacggtaacggttccgtaccgtacgttccgtaccgaccccgggtcccgaaccggtacccgtaccggtccgttaccttaagtttaccgtccgtagggtcccgtaacggttaccgtttaggaaccgggacgggtacgtaaacgggtaccttaacgttaactaacggtccggtacggtaaccggg

SEQ ID NO: 144831 - DNA, 769 bp, Homo sapiens
  misc_feature: GYAE6OF01DPC49.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatcggacctcctgcaacaagaacatgaaacacctgtgttcctcctcctctggtggcagctccagatcgggccctgtctcaggtgcagctggcgagggacggtcgggcccagggactgggtagaacggtccgttccgggggaccctcgttccctcaaccgtgcgtattcgtttcgtcgtacggcctccatcgagtcctaacttaatttaagttgggtcggtaccgtacggggtcccggacccaccggacccccgtaaagggaaaacggaggtccgttagggacggttagggtaaggttgggggaaactacgtacctaagtaccgtaacggtacccgggggaactacccaaaccgtaaactaacccgaacgttccccgtacccgtaacgaacgtacgtacggacgtacccaactattaattactaagtacgtaacgaccgtaaccgaaactaaccctagtttaccctacccgtaaggtaaccgggttcgacccttcgtacggtccggaacccggccgggaacccggtaaccgtacccgggtacgtttaccttaacgttacggttcggaccgtcgggaaccgtttaggttacggaacgggttaaacgggaccgtaacgggttaccttaacgtattaacgtcccggtaggtaccgggg

SEQ ID NO: 144832 - DNA, 650 bp, Homo sapiens
  misc_feature: GYAE6OF01C5SGF.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtggttcctcctcctcctggtggcagctcccagatgggccctgtctcaggtgcagctgcgagggacgtccgggacccagggtactgggtacgaacgtcccgttccggggaccctcgtccctcaccgtgcgtattcgtttctcgtcggctcatcagctacttattaagttcggtcggtaccgtcgggtcccgccgacgaccccgaaggaacgtggcgtaggaggtagggtagtggggagtactcgtagtaccgaacgtaccgggagccaaaccaactacactcccgtacctacgaagtacgtacgacgtacactatactctaagtacgactacgtacgaacctaccgtacgttcctaccgtaggtaacgtcgaccgttcgtaccggtacggacccgaccggaccggaccgtaccggtctacgttacgttcgtcggtcggtacggtcgttacttcggaacggacggtacgacggttactaacgttagtacgtccgtcgggtacggg

SEQ ID NO: 144833 - DNA, 877 bp, Homo sapiens
  misc_feature: GYAE6OF01DZT1K.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcaacaagaacatagaacacctgtcgttcctcctcctcgtggtgcagcctccgagacgtcggcccttgtctcgaggtcgcgacgcgtgaccgagggtacggtccgggacccgaaggtaccgttagggtacgaaaccggtccccggtttccggggacccttccggtcccctacgtaacccgtggtaccgttacgtttccgtttcgtccggtcgtacctaccgaacgttcgacgtactaacttaagtttaacgttgggtacgtacccggtccggtcccgacccgtaccggaccccgtaagggaacgacggtcgtaagggtaggtagggtacggttacggggaagtacttacgtaacgtaccggaaccggtaaccgggaactacccgaaaccgtaaacctaacccgtaccgttaccccgtaccgtaacgtaaggtacgtaccgtaacctacccgtaaactaatttaacctaacgtttaacgaaccgtaacctaaacccggttaacccgaaaaaccgtaccccgttaacggtttaccccaacccggttaaggtaaccggttacccttaccggtaaccgttccggaacccggacccccgggtaccggaacccgggtaacccgtacccgggttacctaaaccgtttacgttaacccggtggtaccggacccggtttacgtaacgttacgggaacgggttaacggaacggttacgtaaaccgttaactacgttaaccgtccggtaacggtaccggggg

SEQ ID NO: 144834 - DNA, 668 bp, Homo sapiens
  misc_feature: GYAE6OF01BPSLB.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggacgtggtgaagcccgttccggggaccctcgtccctcacctgcgattgtttctcgtggctcgatcagctactattaagttgggtcggaccttgggtcccgtccgacgcccccgaaggaaacggaggccgtgggtaggtggtacggtttggggacgtagtcgtatcgagtaccgggagcctaaccaaactaacaacgttcccgtaccctacgaacgtacgtacgacgttaccacctattactactaagtacgaccgtacgtaccgaaacaccgtacgttccgtaccgtagtaacggtcgaacctcgtcgacggtaaccccgccgaccggtaccgtacccggcccgtacttacgttacttcggtacgtccgtacggttatttaccggaacgggtacgggaactaacgggttaactaccgttaagtacggtccgtaacggttaccgggg

SEQ ID NO: 144835 - DNA, 940 bp, Homo sapiens
  misc_feature: GYAE6OF01EJIGI.5.23.C01.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
tcagatcagacacgcacgaccggtgctcgatttagtacacgtgattagggattgggcacgaccggtgctcgatttagtacacgtgattagggattggggatactttctgagactcatcggacctcctgcacaagaacatagaacacctgtcgttcctcctcctccgtggtgcagctccagngtcggcctgtctcgaggtncgagctggcgaggacggtccgggccaggacgtggtacgacgtccggttccgggacctcgtcctcacgtgctagttcgttactcgtacggtccttcacgtacgactactacgtttaagtttacggttcgggtcgggtaccggttccggggtaccccgaccggtacccggacccccggaagggtaaacggcggcgtagggtacgggtagggtagggttacggggaacgttacgtacgtacgaacgaacggtaccggggacaacctaaccgtaacctacgacccttacccgaccgttaacgaacggtacggtccgtaaccgtaacctaaacgtacgttaacctacgttaacggtaaccgttaaccgaacggttaacccgtaaaccctaacccgtttacccgggttttacctaccccggttaaagggttacccgggtttaacccgtaccgtttaccgggttttaccgggtaaccccgggacccccgggtaaccccgggggtaacccgtaaaccccgggttacccgggtttacccccgtttaaaccggtttaccggtttacccgggtttaccgggtacccggggtttaaccccggggttaaccgggtttaccggtttaaacccggggaaacgggggggtacccggggttaaaacggttaaaccccgggttaaccccgggttttaaaggttaaccccggtttaaaccgggggtttaacccccggttggggggttaaaccccggggg

SEQ ID NO: 144836 - DNA, 690 bp, Homo sapiens
  misc_feature: GYAE6OF01BG9RD.5.23.C01.1.454.CMB.1.raw
  modified_base (201)..(201): a, c, t, g, unknown or other
  misc_feature (201)..(201): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtgggccctgtctcgaggtncagctgcgaggacgtccgggcccaggtacgtggtagaacgtcccggttccggggaccctcgtcccctccgaccgtgcgtagttcgtttctcggtcggctccatcagtctacttaagttaagttggtcggtaccgtcgggtccgcccgacgaccccgaagggaagcggacgtggagtgggtagttgggagtagtccgtagtacgacgtacgggacactaaccgaactaaccaacgtcccgtaccctacgaacgtacgtccgacgtccaacctaacttactactaactaacgaaccgtaccgtaaccgaacctaaaccgtaccgtttaccctacccgtacgtaacggtaccgtaccgttcgtacggtccgacccggtccggaaccggacccgaccggtaccgttacttacgttaccgtcgtacggtcggtcggttacgttacggacggacggacgtacggtaactacgtaagtacgtcggtacggtacggg

SEQ ID NO: 144837 - DNA, 711 bp, Homo sapiens
  misc_feature: GYAE6OF01EID2U.5.23.C01.1.454.CMB.1.raw
tcagatcagacacgcacgaccggtgctcgatttagtacacgtgattaggggattgggcacgaccggtgctcgatttagtacacgtgattagggattggggatactttctgagactcatggacctcctgcacaagaacatgaaacacctgtgttcctcctcctcctggtggcagctcccagatggccctgtctcaggtgcagctgcgaggacgtcgggcccaggtactggtgaacggtcccgttcggggacctcgtcccctcacctgcgtagttcgtttctcgtcggtctccatcagctactagtttaagttggtcggtaccggttcgggtcccgccgacggaccccgaagggaaacgacggtcgtagggacggttaggtaggttaggggaagtacgtcgtacgtacgtaacggtaccgggacgtaccaaccgtaactaaccgaacgttcccgtaccctacgaagacgttacgacgtaccaaccgtattactactaacgtaacgaccgaacgtaccgtaaacctaacccgtaacgtttcctaaccccgttaaggtaaccggttccgtacccgttacgttcggtacccggaccggtaccggtaccgggaccgtaccggtacccgtacgttacgttacgtcggttacgccggtacggttagttacgacgggaacggaccgtagtacttacgtacgtacgttcggcgttacgggg

SEQ ID NO: 144838 - DNA, 863 bp, Homo sapiens
  misc_feature: GYAE6OF01CF3BJ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatcggacctctgacacaagaacatacgaactactgtcgttcctcctcctcgtggtcgacacgtcctaccaggacgtcgggaccctgtacctcggaggtcgacgtacgtcgtacggacgagggtaccggtcccgggaccgtaagggtacgtacgggtacggtaaccggttcccgggttaccggggtcccttaccggttcctaccgtaccgtcggttaccgttacgtttccggttttccgtacggtaccgtcccgtacctacgtacgacgtactaacgttaagttcggtcggtcgtaccgttccggaccaccgaccgtaaccggaaggacgtcggtacgtagggtacggtacggtaacggtggacgtacgtcctacggtaccggaacggtaccggaactaccgaaaccgtaaccgtacctacccgtacccgtaccgtaacgacggttaccgtacgtaccgtacaaccggttaacttaccgtacttaaacgtccggtaaaacctccggtaaaccaacccgttaacgttcccgttaacctacgggttacggaaccgttaccgtaccgttaccggtaccggggtaccccacccggtaccgggacccgttaacccggttaccggtaccgttaaccgttccggttaccgacggttacccgggtaccggtttacgttaaccggtaacgggtacgggtaaccgttaaggacccgttaaacttcggttaacgacccggttggtaacccgggtacgggg

SEQ ID NO: 144839 - DNA, 830 bp, Homo sapiens
  misc_feature: GYAE6OF01DR1NY.5.23.C01.1.454.CMB.1.raw
  modified_base (137)..(137): a, c, t, g, unknown or other
  misc_feature (137)..(137): n is a, c, g, or t
tcagatcagacacgcacgaccggtgctcgatttagtacacgtgattagggattgggcacgaccggtgctcgatttagtacacgtgattagggattggggatactttctgagactcatcggacctctgcacaagaacntagaacacctgtcggttcctcctcctccgtggtgcagcctcccagagtcgggccctgtctcgaggtgccgagctggccgtaggacgtccgggccgaggtacgtaggtagaaccggtcccgttccgggacccttcgtcccctacaccgtggcgtacgttcgtttcgtcggtcggtccttcccacgtcgacggacctaactttaacgtttaaggttcgggttacggtaccggttcgggtcccggacccgtacccggaccccccggaagggaaaacggacgggtcgtacgggtagggtagggttaggttaggggaacgttaacgttacggtacgtaaccgtaacggttaaccggggacgtaacccgaacctaaaccgtaaccgtaaccgtcccggtacctacgaacggtacggtacgtaccgtacctaaccgtactacgtactaacgtaacgtaacaccgttaccgaaccttaaccgtacgttacccgttacgtacggaacgttacgtaccttcggtacgtaccgggtacccgtacccggaacgggtacccggtaccgggtacccgtttaacgttaaccgtttaccgtacggttaccggtaccgggtacgttaccggttacggtaaccggggaacgggtacctaaacgggttacttaacccggttacttaaccggtccggtacggttacccggggg

SEQ ID NO: 144840 - DNA, 756 bp, Homo sapiens
  misc_feature: GYAE6OF01BT7EL.5.23.C01.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
tcagatcagacacgcacgaccggtgctcgatttagtacacgtgattaggattgggcacgaccggtgctcgatttagtacacgtgattagggattggggatactttctgagactcatggacctcctgcacaagacatcgaaacaccgtgtggttcctcctcctccgtgggtcgcgagcctacccgagtacgtcgggccctgtacctcgaggtcncagtcncggcgtagggacgtccgggacccaaggccgttgggaccgaacggtcccggttaccgggacccttcggcccctcgaccgtgccgtagttcgttccgtcggtcgtcctccgactctagacctacgttaacgtttaacggttggtccggtaacccggtcgggtaccccgtccggaacccggaccccgaagggtaaaacggcgggtacggtaggtaacggtcgggttaagggtaggggtacgtacgtactaacgtaccgaaccggtacccgggacgtaacaaccgtaacctacgtaacccgtccgtaccctaagacgtacgtcgactaccgactatacgtactagtaccgaacgtacgtaaccgaacctaacccgtcgttaccgtacccggagttaccggtacgtaccgttcggttaccgcggaccccgtaccgtaccggtaacctccggccttacgtaccgttacggtccgtcgggtactccgggttataccggaacgggtacgacgtacgtcgtaactacgttcggtcgtacggtccgg

SEQ ID NO: 144841 - DNA, 734 bp, Homo sapiens
  misc_feature: GYAE6OF01EARIU.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagtcccgttcgggaccctcgtccctcacctgcgtattgttctcgtaggctccatcacgctactatttaagttgggtcggtaccgttcggggtccccgcccgaacggtccccccgaagggaaacgacgggtcgtaggggtacggttgggtacggttgggggaacgtacgtacgtaacgtccgaacggttaccggggaacgaccgaaccctaaactaaccgtaaccttccccgtaccctacgaaacgtacgggtacgtaacgttaccaaccgtaacttatacctaagtaacgaaccgtaccgtaaccgaaacctaacccgtaacgtttcccgtacccgtaaggtacggtaccgtaaccgtcgttccggtaccggtaccccgacccgggtaccgaaccgacccggtacccgttcttaacgttaccgtcggtacggccggtacggttacttacggacgggtaagggaccgtaacgtacgttaactagttacgtccggtcggtaccggg

SEQ ID NO: 144842 - DNA, 805 bp, Homo sapiens
  misc_feature: GYAE6OF01AWS7S.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtgggccctgtctcgaggtcgcagctggcaggacggtccgggcccaggacgtggtaggaacgcccgttccgggggacccttcggtcccctccgaccgtcggcgtacttcggtttccgtcgtcggtcctcctactcagcctacttaattagttcggtcggtacccgttcgggtcccgcccgtaccggacccccgaagggaaaacgcgggcggtacgggtaggtacgggtaggttaggggaacgtacttacgtaacgtacggaacggtaaacccggggaacgtacccgtaaaccgtaacctaaaccgtaaacccgtttccccgtacccgtaacgaacggtacgtaccggtaacgtacccaaccgtaacttacttaccttaaacgtacaaccgtaaccgttaaccgaaacccgtaaaccctccgtttaaccctaccgtaacgggtaacggtccgtaacccgtttcgtaccggtcccggaacccgggtccggaaccggtaacccggtacccggtccgtaaccgttacgttaccgttcggtcggtaccggtccggttaacttacgggaacgggtaacggaccgtaacgtaccgttaacgttaatacccggttccggtacggtaccgggg

SEQ ID NO: 144843 - DNA, 839 bp, Homo sapiens
  misc_feature: GYAE6OF01D2OPV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctccgtggtggcagctcccagatcgggccctgtctcaggtcgcagcgtgcgaggaggtccgggacccgaggtacgtggtagaacggtcccgttccgggaccccttcgtcccctcaccgtggaccgtacgttcgtttaccgtccggtcggtccctaccctactaccgacgtacctaaccgttaagttttaacggtttacggggtaccgggtaacccggttccgggggtaccccgacccgtaacccggacccccggaaagggaaaacggacgggtaccggttaggggaggttacgggtaacggttaggggaacgtacgttacgtacgtacgtaaccggtaacccggggacacccgaaccctaaacctaccgtaaaccttcccccggtaccctaacgaaacggtacggtaccggtaaccggttaacccaaccgtaattaaacttaccgtaataaacccgaaccgtaacccggtaacccgaaacctaaaccccgttaccgtttacccgtacccgttgggtaaacggttccgtaccgttacgttacggtaccggaccccggtccggaaccggaccgtaccgggtacccttacgttacgttcgtcggtcggtaccggtacggtacgttaggaaccgggtagggaccgtaggtaacctacgtaataccgtcggtcggtaccgggg

SEQ ID NO: 144844 - DNA, 972 bp, Homo sapiens
  misc_feature: GYAE6OF01EBTTV.5.23.C01.1.454.CMB.1.raw
tcagatcagacacgcacgaccggtgctcgatttagtacacgtgattagggatgggcacgaccggtgctcgatttagtacacgtgattagggattggggatactttctgagactcatggacctcctgcacaagaacatgaaacacctgtgttcctcctcctctggtggcagctccagagtcgggccctgtctcgaggtgcgagctcggacgagggacggtccgggtacccgaggtacgtacgggtcggaacggtccccggttccgggggtaccccttcggtaccccctccgacccgttcggaccggtagtttcgttttccgtccggtacggcccttacccgtacgtaccgacgtacctaactttaacgtttaacggtttacgggggtaccgggttacccgggttaccgggggttacccccggtaccccggtaaccccggtaacccccggaaaaggggaaaacggtacgggtaccggttacggggtagggtaacggggttaaacgggttacgggggtaaagtacgttaccggttaaccgtaacccggtaacgggtaaacccggggtaacgtaacccgtaaacccgtaaacccgtaaaccttaacccggttaaccccccgttaacccgtaacggtaaacgggtaccgtaaccgggtaaccgtaacccgtaaccgttaactttaacgttaacccttaacggtaaacggtaacccgaaaccggtaacccctaaaaccggtaaccctttaacggttaccccgttaacccgtaagggtaccggttaccgttacccgttaaccgttcggaacccggtaccccggtacccgggtaccgtaaccgggtaccccgggtaccgttaccgttaaccggttacggtccgggtacggtccggtaaccggtttacggtacggtaaaccggaacgggtaacgtaacggtaaccgttaacgtaacggtacggttccgtcgggtaccgggg

SEQ ID NO: 144845 - DNA, 778 bp, Homo sapiens
  misc_feature: GYAE6OF01DKC8Y.5.23.C01.1.454.CMB.1.raw
  modified_base (126)..(126): a, c, t, g, unknown or other
  misc_feature (126)..(126): n is a, c, g, or t
  modified_base (666)..(666): a, c, t, g, unknown or other
  misc_feature (666)..(666): n is a, c, g, or t
tcagatcagacacgcacgaccggtgctcgatttagtacacgtgattagggattgggcacgaccggtgctcgatttagtacacgtgattagggattggggatactttctgagactcatggacctccngcacaagaacatagaaacacctgtcggttccctcctcctcctggtggcagcctcccgagagtcgggccctgtcctcgaggtgccagctgacgaaggcgtcggccaggacgtggtagacgccgttcgggaccctcgtccctacaccgtggccgtaagttgtttccgtacggtcgtccttaccgagtaccgacgtaccaacgtttaagtttaacggttcgggaccggtaacccgtttcgggtacccgacccgaaccccggaccccgtaaaaggggtaaaacgacgggccggttacggggtaacgggtagggtaaccgggttagggggaacctaacggtttactaacgtaccgggtaaacgttaacccgggggaacgacctaaaaacccggtaaacttaaacccgaaaccgttcccccggtaaccctaagaaacgtaccggtacggtacgaacctaacgaacttacttacgaagttaaacggacctaaacgtaccaaacgtaaccctagttccctaaccggtaggtaacgcctaaccgtttcncggtacccgaaccggccgcggtaccgacggtcccgtaatacgttacgtcgacggtcgcggttatcggaagggacggaacgaccggttaattacgagcttacggcgtacgggg

SEQ ID NO: 144846 - DNA, 462 bp, Homo sapiens
  misc_feature: GYAE6OF01CZSW2.5.23.C01.1.454.CMB.1.raw
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (414)..(414): a, c, t, g, unknown or other
  misc_feature (414)..(414): n is a, c, g, or t
  modified_base (443)..(462): a, c, t, g, unknown or other
  misc_feature (443)..(462): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctatactgtgcgcggatttcagagggacaggactactatatcgacgtctggggcagagggaccacggtcatcgtctcctcngccctccaccgaacgggcccacgtccggtacctttcccccgtcggccaccccgttccctacccaacgacncctaccctcgtcgggggacacgagccggcccgtcgggcgtgccgtcgtcgaacggactaccgttccgtagtctgatcgngtagcggctcgggcgacgggcgcagtagnnnnnnnnnnnnnnnnnnnn

SEQ ID NO: 144847 - DNA, 760 bp, Homo sapiens
  misc_feature: GYAE6OF01DR9T4.5.23.C01.1.454.CMB.1.raw
  modified_base (128)..(128): a, c, t, g, unknown or other
  misc_feature (128)..(128): n is a, c, g, or t
  modified_base (145)..(145): a, c, t, g, unknown or other
  misc_feature (145)..(145): n is a, c, g, or t
  modified_base (171)..(171): a, c, t, g, unknown or other
  misc_feature (171)..(171): n is a, c, g, or t
  modified_base (322)..(322): a, c, t, g, unknown or other
  misc_feature (322)..(322): n is a, c, g, or t
  modified_base (592)..(592): a, c, t, g, unknown or other
  misc_feature (592)..(592): n is a, c, g, or t
  modified_base (681)..(681): a, c, t, g, unknown or other
  misc_feature (681)..(681): n is a, c, g, or t
  modified_base (692)..(692): a, c, t, g, unknown or other
  misc_feature (692)..(692): n is a, c, g, or t
tcagatcagacacgcacgaccggtgctcgatttagtacacgtgattagggattgggcacgaccggtgctcgatttagtacacgtgattagggattggggattactttctgagactcatcggacctccngcacaagacatagaacnccgtgtcgttccctcctcctcgtggngcagcctacccgagtcggtcgggtccctggtactcgaggtcgacgacgtcgacggacggtacgggacggtccgggaccgaggtacgtgggtacggtaccgttcccgggttaccgggccccttcggtccccgtaacgtccggtcggtcgttntttccggttcgtccggtaccgcttaccagtaccgactacgtttaacgttagtttacgggtcgggtaccggtacccggttccggacccgaccgaccccggaaccggaaagggacggtgacggtaggtaggtaggggacggtaggtaactctacgtacgacgtaccggtacggacaacccgtaacctacgtaacctacccgtccgtaccgaaagtcggacctacgtaactaccattacataccggtaacacgtaaccgacgtaacaaacccncggtttacctacccggtacgtacggtacgtaccaccgttggaacccggacccgtcccgggacctaacggccgttacccgtaccgttacnggtttcccggngaccgtccgttagttacggacggacggtaaccgactgtaacctggtaacgtccgaggtccgaacgggg

SEQ ID NO: 144848 - DNA, 635 bp, Homo sapiens
  misc_feature: GYAE6OF01CIE6Z.5.23.C01.1.454.CMB.1.raw
  modified_base (198)..(198): a, c, t, g, unknown or other
  misc_feature (198)..(198): n is a, c, g, or t
  modified_base (409)..(409): a, c, t, g, unknown or other
  misc_feature (409)..(409): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctccagatgggccctgtctcaggtncagctgcaggagtcgggcccaggactggtgaacgccgttcggggaccctgtcccctcacctgcgtatgtttctcgtggctccatcagctacttaattaagttgggtcggaccgttcgggtcccgcccgaccggtcccccgaaagggaaacgacggcgtagggaggtgggtaggtttgggggaagtacttcgtatacgaacgtaccgggganaccaaccaactaccaactcccgtaccctacgaacgtacgtacgagtaccaccatactactaatacgactacgtacgaaactaactacgttcctacccgtagaacgtcgaccttgtacggtccggaacccggtccggaccggaaccgtaccggtccgtacgttaccttacgtgtacggcggtcggtattcggagacgggacacggtactactatacgtcgcgtcggg

SEQ ID NO: 144849 - DNA, 780 bp, Homo sapiens
  misc_feature: GYAE6OF01C83EP.5.23.C01.1.454.CMB.1.raw
  modified_base (286)..(286): a, c, t, g, unknown or other
  misc_feature (286)..(286): n is a, c, g, or t
  modified_base (704)..(704): a, c, t, g, unknown or other
  misc_feature (704)..(704): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctccctcctcctcggtggcacgctcccagagtggccctcgtctccgaggtgcagctgcgaggaggccggggacccgaggacgtggtacgaacggccgttccggggacccgtccgtccctccacctggacgtnttcgtttccgtcggtcggcctaccagtacacgactaacttacgtttaagttcgggtacggtacccggtcggggtacccgcccgaaccggaccccccggtaagggaaacgggtacgggccgtagggaagggtaggggtacgggttagggggtacctaagtaccgtacgttaccgaacgggttaaccggggaacaccctaaacccgtaaacctaacgtaaccgttacccccgtaccttacgaaacgggtcgtaaccggtaacgtacctaacctaacgtacttacgttaagaacgtaacgaccctaacggaaacctacctaacgttacctaccgttaggaacggttccgtaaccgtacgtcgtaccggacccggtccgaccgggaccgtaccgggtcctacgtttcgtaacgtcgggtacncgggtaccggttaagttcggtaagggaccgggtaacgacgttaacttacgagttaacgtccggtacgtaccggggg

SEQ ID NO: 144850 - DNA, 832 bp, Homo sapiens
  misc_feature: GYAE6OF01D0T2V.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtggttcctcctcctcctggtggcagctcccagatgggccctgtctcaggtgcagctgcaggagtcgggcccaggactggtgaagccgttccgggaccctgtccctcacctgcgatgttcgtcgtggctccatcacgctactatttaagttgggtacggaccgtcggggtcccgaccgaccgccccgaagggaaacgacgggtaccgtagggtaggtagggacgtttgggggaacgtagttacgtagtacgaacgttaaccggggaacgaccctaacccgtaaaaccgtaaccgtaaacgttaccccgtaccccgtacgtaaaacggtacggtaccggtaacggtacccaaacccgtaattaacgttaccgttaaataaccggaaacgtaacccggtaacccgaaaccttaaaaccccgtaccggttttaacccgttaccccgtaacgggtaaaccggttaccggtaacccttaccgttacgggtaccggtaacccccgggtacccgggtacccgggtaacccgtacccggggtacccgtttacccgttaagtttacccgttgggttaccgggtacccgggtaccgggtttaagtttaacccgggaagggtaaaccgggtaaccgaaacggggttaaaccctttaacgtaacgtttaaccgtccgggttaacccggttaccggggg

SEQ ID NO: 144851 - DNA, 728 bp, Homo sapiens
  misc_feature: GYAE6OF01DP3Z7.5.23.C01.1.454.CMB.1.raw
  modified_base (205)..(205): a, c, t, g, unknown or other
  misc_feature (205)..(205): n is a, c, g, or t
  modified_base (494)..(494): a, c, t, g, unknown or other
  misc_feature (494)..(494): n is a, c, g, or t
tcagatcagacacgcacgaccggtgctcgatttagtacacgtgattagggattgggcacgaccggtgctcgatttagtacacgtgagttagggattggggatactttctgagactcgatggacctctgcacaagaaccatgaaacaccctgtggttcctccgtcctcctgggtgctagctcccagatgggccctagtctcaggtncagctgcgagagtcgggccaggacctggtcggaacgccgttccggggaaccttggtccctcgaccgtgtccgtattgtttcgtcgtggtctacctatccagcacttattaattggtcggtaccgttgggtcccgaccgtacgacccccaagggaacgtacgggactacggtaggtcgggagttaccggggagtacgtccttacgtcgacgttaaccggagaccgaaccgaaacgtacaaacgtccggtaccctagaagtacgtacgtagtaccaacgaatactacgtanaacgtacgacgtacgaacgtaacctacgttccgtacccgtacgaacggtacgaaccgttcgtacggtacggtaccccggtacccgaccggaacccgtaccggtcccgtaacgtttaaccgtaccgttcgggtaaccgtcgggtaaccggttactttacggaaaccgggaacgggttaccggaaacggtaccggttaaacctaagtttaccgtaacggtaccggttaacccgggg

SEQ ID NO: 144852 - DNA, 543 bp, Homo sapiens
  misc_feature: GYAE6OF01CJU08.5.23.C01.1.454.CMB.1.raw
  modified_base (270)..(270): a, c, t, g, unknown or other
  misc_feature (270)..(270): n is a, c, g, or t
  modified_base (495)..(495): a, c, t, g, unknown or other
  misc_feature (495)..(495): n is a, c, g, or t
  modified_base (498)..(500): a, c, t, g, unknown or other
  misc_feature (498)..(500): n is a, c, g, or t
  modified_base (502)..(503): a, c, t, g, unknown or other
  misc_feature (502)..(503): n is a, c, g, or t
  modified_base (505)..(507): a, c, t, g, unknown or other
  misc_feature (505)..(507): n is a, c, g, or t
  modified_base (509)..(543): a, c, t, g, unknown or other
  misc_feature (509)..(543): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtcgaccgccgcggacacggccgtctattactgtgcgcggatttcagagggacaggactactatatcgtacgtcgtgggcaggacgggaccacggtcagtcgtactccncacgccaccgacgacggcctacgtccgtcccgttccccgtcgtaccctacccctcctaccgaacgaccgaccgtaccgtcgggcgggaccaaccggacggtcccggccggtcggtccgtcggtccggttacggtaccgaaaccggttaccgttacccggttcccggtcgtcgtacgtacgtcggtacggcgggcggtacgtcgggacgacgggccaactagacgngannntnncnnngnnnnnnnnnnnnnnnnnnnnnnnnnnnnnnnnnnn

SEQ ID NO: 144853 - DNA, 682 bp, Homo sapiens
  misc_feature: GYAE6OF01AWD26.5.23.C01.1.454.CMB.1.raw
  modified_base (144)..(144): a, c, t, g, unknown or other
  misc_feature (144)..(144): n is a, c, g, or t
  modified_base (211)..(211): a, c, t, g, unknown or other
  misc_feature (211)..(211): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
  modified_base (385)..(385): a, c, t, g, unknown or other
  misc_feature (385)..(385): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacncctgtggttcctcctcctcctggtggcagcctcccagatgggccctgtctcaggtgcagctgcaggngtccgggcccaggactggtgaagtcccgttccgggaccctcggtccctcaccgtgcgattcgtttcgtcgtcggctccagtcagcacttattaagtggtcgaccgtggccncgacgccccgaaggaagcggcgtggngtggagttgggacgatcgtagtcgaacgtaccggganaccacctaacctacaaccgtcccggtaccctacgaacgtagtaccgacgtaaccgaactactacttacctaatacgaacctaacggtaccgtaaacccgaaccgtacgttcccgtacccgtaggtaacgtccgtaacctcgttacggtaccggacccgtacccggacggtaacccgtacccggtaccggttacttacgttacgtcggtacggtccggttacgggtacgtttacggaaagggtaccggaccgaaggtacccttaaacgttacgtaacgttccgggaccggttaccggg

SEQ ID NO: 144854 - DNA, 927 bp, Homo sapiens
  misc_feature: GYAE6OF01CXW3Y.5.23.C01.1.454.CMB.1.raw
tcagatcagacacgcacgaccggtgctcgatttagtacacgtgattagggattgggcacgaccggtgctcgatttagtacacgtgagttagggattggggattactttctgagactcatcggtcctcctgacaacaaagaacatacgaactacctgttcgttcctcctcctccgtggtcgcacgcctaccgagacgtccggcctgtcctacgaggtcgacgacgtcgtacggaccggacggggtaccgggtaccgggacccggtacggtaccggttagggttaccgggaaacccggttcccggggttaccccgggtaccccgttcccggttcccctaccgtacccgttcggtaaccggtttctttccggtttccgtagggtttccgtacccttaaccgaccgtactaccggttaactttaaagtttacgtttacggggttccggggaccggtttaccccgggttaccggggccccaaacccggaccccggtaaaccgggtaagggaacggtaccggtcgggtaaggggtaggttacggggtacgggttagggtaacctacgttacggtaaaccgaccgggttaaacggaacccggacgtaaacctaaacccgtaaaaccttccggtacccgtaaccccgtacggtaacgtaacgtacggaacccgttacaaaccgtaactaacgttacgtaactaaccgtaacgtaaccgtaaccggtaaccaacgtttaaccccgtctaaccgtaccggttacgaaccggttcctaaccgtcttaccgggtaccggccccgtaacccggtacgtaccccggtagttcccgtaaggttaaccgttccgggccgtttaaccggcggttaacgtacggtaccggacgggaccgtaacgtaacggtaccttacggtaagtccggtcggttacggtagggg

SEQ ID NO: 144855 - DNA, 550 bp, Homo sapiens
  misc_feature: GYAE6OF01CU3Z0.5.23.C01.1.454.CMB.1.raw
  modified_base (205)..(205): a, c, t, g, unknown or other
  misc_feature (205)..(205): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (499)..(500): a, c, t, g, unknown or other
  misc_feature (499)..(500): n is a, c, g, or t
  modified_base (503)..(503): a, c, t, g, unknown or other
  misc_feature (503)..(503): n is a, c, g, or t
  modified_base (505)..(507): a, c, t, g, unknown or other
  misc_feature (505)..(507): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(522): a, c, t, g, unknown or other
  misc_feature (518)..(522): n is a, c, g, or t
  modified_base (524)..(527): a, c, t, g, unknown or other
  misc_feature (524)..(527): n is a, c, g, or t
  modified_base (529)..(532): a, c, t, g, unknown or other
  misc_feature (529)..(532): n is a, c, g, or t
  modified_base (534)..(535): a, c, t, g, unknown or other
  misc_feature (534)..(535): n is a, c, g, or t
  modified_base (537)..(540): a, c, t, g, unknown or other
  misc_feature (537)..(540): n is a, c, g, or t
  modified_base (542)..(542): a, c, t, g, unknown or other
  misc_feature (542)..(542): n is a, c, g, or t
  modified_base (544)..(546): a, c, t, g, unknown or other
  misc_feature (544)..(546): n is a, c, g, or t
  modified_base (548)..(550): a, c, t, g, unknown or other
  misc_feature (548)..(550): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttcctccctgaaggtcgacctctgtcgaccgccgcggacacggccgtctattactgtgcgcggtnttcagaggacaggactactatatcgacgtcgtggggcaaggacgggaccgacggtcagttccgtctcctcacgccctaccgaaccgaacggccctagttcccggttcccttcccccgtcggacccctaccccttacctaccgaaaggtaccgcctaacccgtcgggtcgggggacaccgacggccggtaccgtcggctacgccgttcggacgaacggtacctttacgtcccgtgtctgtactacgtggacggtcggcgtcggacgtacggcgacgtagtagcngcagcngacgnntancnnngncngcncncnnnnncnnnncnnnncnncnnnncncnnncnnn

SEQ ID NO: 144856 - DNA, 708 bp, Homo sapiens
  misc_feature: GYAE6OF01BHSNS.5.23.C01.1.454.CMB.1.raw
  modified_base (429)..(429): a, c, t, g, unknown or other
  misc_feature (429)..(429): n is a, c, g, or t
  modified_base (529)..(529): a, c, t, g, unknown or other
  misc_feature (529)..(529): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtcggttcctcctcctccgtggtggcagctccagagtcgggccctgtctcgaggtcgcacgctgcgaggtacggtccgggcccaggtaccgtggtacggaacgtcccggttccggggacccttcgtccccttcaccgtgcgttagttcggttttccgtcggtcggtcctaccgtatcgacgacctaacgttatttaacgttgggtacggtaccgttcgggtcccgccgtaccgaccccgaaggaaaggcggtcgtagggtacggtagggtagtggggtaanattcgtatcgtacggtacggcacaaccgaactaccgaacctccgtacccatacgtagtccgtaactacgactagttactactaagtacgacctaccgtanaaaccctaacgtacgttaccctacgtacggacgtaccgtcctgtaccgcggacccgtccggacgtaccgaccggtaccttcgtacgtttactcggtacggtcgcgggttaacgtttacgcccggggaacggtacggtaacgtacccgtaacttaagtacttacgggtaccggtaccggg

SEQ ID NO: 144857 - DNA, 788 bp, Homo sapiens
  misc_feature: GYAE6OF01DF1YZ.5.23.C01.1.454.CMB.1.raw
  modified_base (720)..(720): a, c, t, g, unknown or other
  misc_feature (720)..(720): n is a, c, g, or t
tcagatcagacacgcacgaccggtgctcgatttagtacacgtgattagggattgggcacgaccggtgctcgatttagtacacgtgattagggattggggatactttctgagactcatggacctcctgcaacaagaacatagaactaccgtgttggttccctcctcctccgtggtgcagctcccagacgtcggcctgtctcgaggtgcagctgcgaggtcggtccgggcccaggtacgtggtagtaaccggtcccggttaccgggccctccgtcccacctcgtcgtacgttacgttcggtttccgtcggtcgtcctacctacgtcgtacgtaccttacgttaaacggttttacgttacggggtaccggtccggttaccggggtccccgacccggaaccccggaaccccggaagggaacggtccggtaggtacgggtggttagggagttggggaactactcgtatacggaacgtaccgggaatacccaacctaaacgtaccctaccgttcccgtaactacggaaggttacgtaccgtaactaccgtaacttaaccgtataactacgtaacgaaccgacgtaaccgaaacctccgttacgtaccctacggtacggtacgtccgtaacctggaccgtaccgggacccgtaccgtaccgggaccgtacccgttcgttaaccgttaaccgttcgtaggtccccgtaagggtaccgttaccgggtanaaaccggggcggtaacccgtaacggttaaacgtacctttaaacggccggtcgttaacccgggtcgggg

SEQ ID NO: 144858 - DNA, 918 bp, Homo sapiens
  misc_feature: GYAE6OF01C1BPS.5.23.C01.1.454.CMB.1.raw
  modified_base (206)..(206): a, c, t, g, unknown or other
  misc_feature (206)..(206): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtcggttcctcctcctccgtggtggcagcctcccagacgtcgggccctgtctcgaggtncagctgacgagggacgtccgggaccagggacgtaggtaggaacggtcccggttccggggtaccctcggtccctaccgtaccgtcggtcgtatttcgtttccggtccggttggtaccctccacttaccgacggtacctaaccttaaggttttaggttacgggggtaccggttaacccggttcggggggttaccccaccccggtaacccgggtaacccccgggaaagggaaaaccgggtaacggggtacccggttacggggtaacgggtaacgggggtttaacgggttaaggggggacgtaaaccgtttacgttaaaccgttacggaaaccggggtaacccgggtaaaccggacccgtaaaaccctaaacggtaaccttaaacccgttaccccggtaacccgttaagaacgggtacggttaccgaaaccggtaccaacccgtaattacccgtaacgtttaaactaacgggaaacccgaaccgggtaaccaaaacccgtaaccgttacccgtttaccgtacccccgtttaaggggttaacccggtacgtaccccgttacgtaccgggtacccgaacccggggtcccgaaccgggtacccggtacccggttacccgtaactttacgttaccggtcgggttaccgccggtaggttaccttagggacggacgtacggttaaccgactttacgaaggtttctacgggccggttacgggg

SEQ ID NO: 144859 - DNA, 909 bp, Homo sapiens
  misc_feature: GYAE6OF01EZB3Q.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtcgggccctgtctcgaggtgcagctggcgagggtacggtccgggcccgaagggtagttgggtaggtaaccggtcccggtttacccgggggaccccttcggttccccgttcctaaccgttcggaccgtacgtttcggttttccgtcggtcggtccttccgaacttccgaacggtacctaactttaagttttaaacggttcggggtaaccgggtacccggttcgggggttcccccgccggtaacccgacccccggaaggggtaaaacggtacggccggttagggagggttacgggtaaggttgggggaactaagttcgtaacgtacgtaacggtaccgggtacgaccaaaccgtaacttaaccgaacttaccccgtacctacgaacggtacgtacggaaccgtacaacctagtttaacctacgttaacgtaacgtaccgtaacccgtaacgaaacccgtaaaccgttacgtttaccccgtaaccgtaacggttaacgggttaccgtaacccgttggttaaccgggtacccgggtaacccccgggtccgggtaaccgggaccccggttaacccggggtaccccgtttaacggttaccgtttaacggtccgggttaacggccggggttaacccgtttaaggtttacccggaaacggggtacggggtaaacctaacgggttaaacccgttacgtttaaacggttaccgtacgggttccgggtaacccggggg

SEQ ID NO: 144860 - DNA, 823 bp, Homo sapiens
  misc_feature: GYAE6OF01EBMXR.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggaccctcctgcacaagaacatagaaacacctgtcggttcctcctcctcctggtgcagcctcccagagtcgggccctgtctcgaggtcgcagctcgcgagggacggtccgggacccgaggtacgtggtacggaacgtcccggttacggggaccacgtccgtcccctcaccgtggccgtattcggtttccgtcggtcggtcctacctatcacgtactacgttaagttagttcgggtacggtaccggtccggggtcccgacccgtaccggacccccggaaagggaaacgggacgggtacggtagggtaggttagggtagggttagggggaacgtacgttactaacgtaccgtaacggtaaccgggacgtaccgaaacccgtaaacctaaccgtaaccgtaccccgtacccgtaacgaacggtacgtacgtacgtaccaactacgttaactactaacgtaacgaacccgtaaccgtaaccgaaaccctaaccgtacgtttacccgtaccgtaacggtaacggttaccgtacccgttacgtaccggtaccgtaccccggtaccggaccggtaacccgtacccggtaaccgttaccgttaccgttaccggtcggtacggtaccgggttaccggttacgttaccgggaacgggaaccgggaacggttaacgggtaaccttaacgtacgttaaccggtccgggtaacccgggg

SEQ ID NO: 144861 - DNA, 793 bp, Homo sapiens
  misc_feature: GYAE6OF01ETL6O.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtgttcctcctcctcctggtgcagctcccagagtcgggccctgtctcgaggtgcagcgtggcaggacggtccgggacccgaggacgtgggtacggaacggtcccggttccggggaccctcggtccctacaccgtgcgtacgttcgttcgtcggtcggctccatcgacgactacttagttagttcggacggtaccgtcgggtccgaccgaccggaccccgaagggaaacgcggtacggtcgggaggttagggtaggttaggggacgtagttccgtaagtacgaacggtacgggacgtacccgaaccgtaacgtaaccgtaaccgttacccgtaccctaacgaaacggtacggtaccgtaacgtaccctaacgtaattaaccgttacgtaaagtaacggaacctaacggtaacccgtaaacccgtaaccgttaaccgttcccgttacccggtaagtaaccggtcgtacccgtcggttacggtaccccggacccggtacccggtacccggtaccggtacccggtacccgttacgttaacgtttccggtacggtccgggtaccggtacggtttacttaaccgggagggaaccgggtaccgtaacgggtaaccttaacgtaacgttaccggtaccgggtcggtaaccgggg

SEQ ID NO: 144862 - DNA, 490 bp, Homo sapiens
  misc_feature: GYAE6OF01BAJYP.5.23.C01.1.454.CMB.1.raw
  modified_base (461)..(490): a, c, t, g, unknown or other
  misc_feature (461)..(490): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcaggagggacgaggactactatatcgacgtcgtggggcaggagggaccacggtcatcgtctcctcacgcctccacgacggcccagtccggtccttcccccgtcggccacccctcctaccaacgacgccaccgttcggtcggggcaccgacggcccggcccgtcgggcctcggccgtcggtaccgaaggtaccctaccgttcccgtgtcgtgactcgtaggacggcgggtcgtcgggacgtaacgggcacgatagtgnnnnnnnnnnnnnnnnnnnnnnnnnnnnnn

SEQ ID NO: 144863 - DNA, 773 bp, Homo sapiens
  misc_feature: GYAE6OF01AQRLK.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagacatgaaacacctgtggttcctcctcctcctggtggcagctcccagatgggccctgtctcaggtgcagctgcaggcggtcggcccaggactggtgaagtccgttcgggaccctgtccctcgaccgtgcgtagtcgtttacgtcgtcggcctccgtactcacgtcacttattaagttcgggtcggtaccgtcggggttacccgccaccggtacccccgaaggtaaacggacgggtccgttgggacggtacgggtagttacgggggacgtacggttaccgtaacgttacgaaccggtttaccgggaacggtccgaacccgtaaactaaccgtaaccgttcccgggtacccttaacggaacgttacgtccgtaacgtacctacctaacgttactaccgttaagtacgaacgttaaccgacggtaaaccctaacccgtcgtttacctcccggttacgtacggtacggtacctcgttacggtaccgggacccgtccgggtaccgggtaaccgacccgggttaccgttaccgttaacgttaccggtcgttaccgggacggtacggttacgtttacgacggggttaacggaacccgttacggtaaccgtttaaccacgtttaacgtcccgggttaccggtaccgggg

SEQ ID NO: 144864 - DNA, 831 bp, Homo sapiens
  misc_feature: GYAE6OF01D6E2L.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtgttccctcctcctcctggtgcagcctccagactcgggccctgtctcgaggtgcgagcgtcgcgaggacggtccgggcccgaggtacgtgggtacgaacggtcccggttaccggggacccttcggtcccctaccgaccgtcgcgtagttcgtttccgtcggtcggtcctaccgactacgacgtacctaacgtttaacgtttaacggttcggggtcggtaacccggttcggggtaccccgacccggtaacccggaacccccggtaaaggggaaaccgggtacgggtacgtacgggggtaaggttacggggttaacgggttacggggaagtaacgttacgtaacgtaccggtaaccggtaaccgggacgtaacccgtaaacgtaaacccgtaacctaacccgttccccggtaaccgtaacggtaaacggtacgtaccgtacggtaccaactagtactacgtacaacgtaccaaccggtaaccaaccttaccgtacgttaccgtaccgtaggtacgtaccgtacttcggtactacccggccggtacccgaccgggtaacctcccgggtacctttacgttacgttacggacggttacggccggttacggttaacgttacggaaccgggtacgggtaactaacggtaaccttaacgttaagtaccggttaaccgtacggggttacgggg

SEQ ID NO: 144865 - DNA, 973 bp, Homo sapiens
  misc_feature: GYAE6OF01CWO47.5.23.C01.1.454.CMB.1.raw
tcagatcagacacgcacgaccggtgctcgatttagtacacgtgattagggattgggcacgaccggtgctcgtatttagtacacgtgagttagggattggggattactttctgagactcatcggacctctgcaacaagaacatacgaacaccgtgtcgttccctcctcctccgtggtcggcacgtcctcccgaggacgtcgggccctgtccgtcgagggtcgacgacgtccgtcggacgacggggtaccggtcccggggaccgtaacgggtaccgttacgggtacggtaaccggttccccgggttacccgggggtaccccttccgtccccgtcgtacccgtggtaccgttacggtttccggtttccggtccggtccggtccttaccgtaacggtcctaacggttacttaacttttaacggtttaacggttcgggggtaccggttccccggtacggggtaccccaaccccggtaccccggaaaccccggaaagggaacggtacgggtacgggtaggggtacgggtacggggttaacgggtgggaaccgttactttacggtaccgttaacgggtaaaccggtaaccgggtaacccgtaacccaaacccgttaaaaccgtaacccgttaaaccccgtccccggttaacctaaacggtaaccggttacgtacccgttaaccgtaccctaacgttaactaaccgttaagtaaacgtaaccgaaacccgtacgtaaaacccgtaactacccgtttaaacgtcccttaaccgggtaacggttacgtacctccggtttacctcgggaacccccgggtaccggtcccggaacccggtcccgggttacccgaaccgtttacgttaaccgggtttccacgggtttaccggacgggttaaccgttacgggttaacggacgggtaacccggtaacgttccgtaaaacgttacttaaccgtacgggttacccggtcgggtaaccgggg

SEQ ID NO: 144866 - DNA, 834 bp, Homo sapiens
  misc_feature: GYAE6OF01B72ON.5.23.C01.1.454.CMB.1.raw
  modified_base (143)..(143): a, c, t, g, unknown or other
  misc_feature (143)..(143): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaacncctgtgttcctcctcctctggtgcagctccagatcgggtccctgtcctcgaggtcgcagctggcgaggacggtccgggcccaggtacgtggtacgaacgtccgttaccgggacccttcgtccctcgtaccgtcgcggtacttcggttttccgtcggtcggtcctcccgtatacgacgtaccgtaacttaacggttaacgtttgggtaccgggtacccgttcggggtaccccgtaccccgtaaccggacccccggtaaagggtaaaccggacgggtccggttacgggtaagggttacgggtaacgggttacggggaaacttacggttacgttaacgtacggtaaccggttaacccggggacgtaacccgtaaaccgtaaaccgttaacctaacccggttccccgtaacccctaacggtaaacggtacggttaccggtaaccgtaacccgtaactaacgtttaacgtacttaaacgtaaccgtacccgtaaccggttaaccaaaccgtaccgtactcccgttaacgtaccggtagtaaccgtctaccgttacgtacggtacccgtacccgccggtaacggtacccgtacggttccctagttaccgtttacggtcgtaccggtccggttacgttaacgttccgggaacgggtaccgtaccgtaaagttacgtactaagtccgtaccggtacggg

SEQ ID NO: 144867 - DNA, 917 bp, Homo sapiens
  misc_feature: GYAE6OF01D8Q3Z.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaacactgtgttcctcctcctccgtggtggcagcctccagagtgggccctgtctacagggtgcagcgtgacgaggaggtccgggccgaggtacgtggtgaacgcccggttccgggacccttcgtccctccgacgtcgcgtagtttcgtttcgtcggtcgtcctaccatcacgactagttaacgtttaagttcgggtacggtacggttccgggtacccgacccggtaccgaaccccggtaaagggaacggcgggtacggtacgggtacggttacggggttaaggttacgggggaattacgttaccgtaacgttaacggaaacccggttaaccggggaacgtaaccccgtaaccccgtaaaaacgtttacccgaaacccggtttccccctaaacccccggtttagaaaacccggggtacgtaccgggtaaaccttacccgaaaccggttatttaaaccttacgttaaagacccgggtaaaccgtaaccccggtaacaaaaaccccgttacccgttacgttttacccccgtaaccgggttagggttaaaccccggtcgtaacccgttcggttaaccgggttcccggacccgggaaacccggttacccgggaacccggtaccgggttacccgttttccgtaacgtttccgggttacgggacccgggtcgggtttaacccggtttaaggtacccgggtaaccgggggtaaaccggttggaaacccggtttaacccttaaaggggtaaaccttttcgggtaaacccgggtcggtacccggggggg

SEQ ID NO: 144868 - DNA, 960 bp, Homo sapiens
  misc_feature: GYAE6OF01DHO90.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaacactgtgtcctcctctctggtgcagctccagatgggccctgtctcaggtgcagctgcgaggagtccgggcccaggactggtgaacgtccgttccggggacccttgtcccctcacccgtgtaccgtagttcgttttccgtcggttcggaccctttccaattccgacgtaacctaacgtttaacgtttaagtttcggggtaccggtaacccggtccggggtttacccggaccccgaacggccccccggaaagggaaacggacggtccgtaaggggtacggtacgggtaggttgggggaacgtacgtttaccgtaacgtaccggtaacggttaaacccgggggggactaaacccggtaacccctaaaaacccgttaacccgtaaacccggtttacccccggtttaccccgtaaaccggtaaacgggtaaccgggtttaaccccggaaacggttacccccaaaacccgttaacggttaaacctttaccgtttaaacggtaaaccggtaaacccgtaaacccgggttaccccgtaaaaccgtaaaccccgtttacgttaccccttaaccccggtttaggtaacccgggttccgttacccgttaaccgttcgggtaacccggtacccccgggccgggtaaccgggtaaccccgtacccgggtccccggttaactttaaaccggtttccgggtaaccggttccgggtaccgggttacccgggtttaacgtttacccgggaaagggtaacccggggtaaactaacccggggttaactttaacccgtaacgtttaaccggtcccgggttaaaccgggttcccgggggg

SEQ ID NO: 144869 - DNA, 729 bp, Homo sapiens
  misc_feature: GYAE6OF01B2FCD.5.23.C01.1.454.CMB.1.raw
  modified_base (274)..(274): a, c, t, g, unknown or other
  misc_feature (274)..(274): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcaggtgcagctggcgaggaggtcgggcccaggtaccgtgggtgaacggtcccgttaccgggggaccccttcggtaccccnctaccgtgcgattcgtttctcgttggcctccatcacgcacttaatttagttgggtcggtaccgtcgggtcccgacccgtaccggaccccgaagggaaacggacggtacggtggtacgtgggtaggttggggagattctaacgtcgtaacggtaccgggacgacgaaccctaactaacctaaccgttcccgtaccctacgaacgtcggtacgacgtaccaaccgtaatactaacgtaatacgaaccctacgtaccaaaccgtaacaccgtttaccctaccgtaaggtaacgtcgaccttcgtacggttcgaacccgcccggaccggtaccgacggttcccgtacttaccgttaacgttcgacgggtcggtccggttacgttccggaacgggtacggtaaccggtacggtaaacccttaagttaaccgtaggttaacccggcgggttaacccggggg

SEQ ID NO: 144870 - DNA, 805 bp, Homo sapiens
  misc_feature: GYAE6OF01BYQKY.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtgttcctcctcctccgtggtgcagctcccagagtcgggccctgtctcgaggtgcagcgtgcgagggaggtccgggcccgaggcgtggtgaacgccgttccggggaccctcgtcccctccaccgtgccgagttcgtttccgcgttcggcctcactcgagctaacttatttaagttggtacggaccgtcgggtcccgacccgaccggacccccgaagggaaacggacggtcggtacgggtaggtacgggtaggttcggggaagtacgttcgtactacggtaacgtaaccggggaactacccgtaaaccctaaacgtaacctaaaccgttcccccggtaccccttaacgaacggtacggtaaccgtacgtaccctaacctaagtttactaaccgttaagaacgtaaccgtaacccggtaaccaaaccgttaaacccgttacgtttaccccttaccccgtaggtaacggttaccgtacccgtttacgtacggttacccggaccccggtacccgggtaccggaaccccgtacccgggtacccgttaaccgttaaccgttaccgttcgggtacggttccgggtacggttaggtttacggaacgggtaacgggacgtaacccgggtaactttacgtaagtttaccgtacggtccgggtaccggg

SEQ ID NO: 144871 - DNA, 703 bp, Homo sapiens
  misc_feature: GYAE6OF01A1GVB.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcggcccaggacgtggtagaacgccgttcgggaccctcggtccctcacctgcgtatcgtttctcgtgctcactcagctactattaagtggtcggtaccgtcgggtccgccgaccggccccgtaagggaacgacggcgtagggtacggtgggtagttggggagtacgtctaagtcgtaagtaccgggaagtacccgaaacctaactaaccgtaactcccgtaccctacgtaagcggtacgtacgtacaccgtaatacgtacttaagtaacgaaccgtaccggtaacctaaccgtaaacccgtacgtttaccctacccgtaacggtaaacggtccgtaacccttcgttccggtacggaccccgggtacggtccgggaaccaccgggttacccgtccttaacgttacgtcggttacggacccggggttcgtaacgttcggtaacgggacgggaccgtaacggtaaccttacgtatacgtacggtcgtaccggggg

SEQ ID NO: 144872 - DNA, 887 bp, Homo sapiens
  misc_feature: GYAE6OF01A48LT.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatgacctcctgcacaagaacatgaaacacctgtggttcctcctcctcctggtgcagctcccagagtgggccctgtctcgaggtcgcagctgacgagggacggtccgggacccgaggtacgtggtacgaacgtcccggttccgggaccttcgtccctcgaccgtgcgtagttcgttccgtcggtacgtcctccacgtacgacgtacctaacttaacgtttaagttcgggtaccggtaccggttccggggtaccccgacccgacccggaaccccggaagggaaacgggtacgggtacgggtacggggtaacgggtagggtaacgggttacggggtaagtaacgttacgttaagtaccgtaacggtaaccggggaaccaaaccgaacctaaaccgtaaccgtaaacccgttaccccgtaccctaacgtaacggtaaccgttaccgtaacgtaccctaacctaagtttaaccaagttaaaccgtaacggtaaacccgtaaccggtaaccgtaaaaccctaacccgttaccgtttacccgtaacccgttaacgggtaacggttcccgttaaccgtttaccggtaccggttaacccggtcccgggaaccccgggtacccgttaaaccggaccccggttaccttacggttaaccgtttaccgacggggttcccggtacgggtaaccggttagtttaacgggaaccggtaaacggggaacccttaaaccgggttacccttaaagttaaccgtaacggtccccgggttaacgggtccgggg

SEQ ID NO: 144873 - DNA, 884 bp, Homo sapiens
  misc_feature: GYAE6OF01DAL0R.5.23.C01.1.454.CMB.1.raw
tcagatcagacacgcacgaccggtgctcgatttagtacacgtgattagggagttgggcacgaccggtgctcgatttagtacacgtgattagggattggggatactttctgagactcatggacctcctgcacaagaacatgaacactgtggttcctcctctcctggtgcagctccagatggccctgtctcaggtgcagctgcgagggacggtccgggacccaaggacgtgggtacgaacggtccgttcggggacccttcgtcccctccaccgtgaccgtattcgtttccgtcggtacggcctaccactccgagtacctaacgttacgtttaagttcgggtacggtaccggttcgggttcccgacccgaacccggacccccggaaagggaaaacggtacgggtaccgtaggggtaacggtaggggtacgggttacggggtaacgtacgtttaccgttaacgtaccggtaaccggttaaccggggacgtaacccgtaaacccgtaaaaccctaaccgtaaacccgttaccccggtaaccctaaccggaaacggtacgggttaaccggtaccgttaccctaaacccgtaagtttaaacttaccgtaaacgtaaccgtaaaccgtaacccggtaacccgtaaaaaccgtaaccccgttaacgttttaacccgttaccccggttaagggtaacccggtttacctacccggttaccgtacggtaccccggtaccgggtcccggaaccgggtaccccgtaccgggtacccttaaccgttacgtttaccgtaccggttcgggtaccggttccggttaacgtttaccggacgggtaaacggggacgtaaccggtaactttaacgtacgttacggtccggtcggtttacccgggg

SEQ ID NO: 144874 - DNA, 488 bp, Homo sapiens
  misc_feature: GYAE6OF01EXHBU.5.23.C01.1.454.CMB.1.raw
  modified_base (161)..(161): a, c, t, g, unknown or other
  misc_feature (161)..(161): n is a, c, g, or t
  modified_base (454)..(454): a, c, t, g, unknown or other
  misc_feature (454)..(454): n is a, c, g, or t
  modified_base (457)..(488): a, c, t, g, unknown or other
  misc_feature (457)..(488): n is a, c, g, or t
tcagatcagacacgcacgaccggtgctcgatttagtacacgtgattagggattggggagatctatcataccgggagcaccaactacaatcccgtccctcaagagtcgagtcaccatatctatagacacgtcgaacaaccagttctccctgaaggtgacctntgtcgaccgccgcggacacggccgtctattactggtgcgcggtattcgaggagggacaggactatatatcgacgtcgtggggcaggagggaccacggtcatcgtcctcctcacgcctccaccgaacggcccatccggtccttccccgtcggccaccctccaccagacgccacctcggtggggcacacggccggcccgtggctcgtccgtcggtacgaacggtaccttacccgttccgtgtcgtagtactcgtggacggccgggtcgtgggacgacgggtccgcgtaacgtgancgnnnnnnnnnnnnnnnnnnnnnnnnnnnnnnnn

SEQ ID NO: 144875 - DNA, 803 bp, Homo sapiens
  misc_feature: GYAE6OF01DZ44Z.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtggttcctcctcctcctggtggcagctcccagatcgggccctgtctcgaggtgcagctgcaggacgtcgggcccaggactggtagaacgtccgttcgggaccctcgtccctcacctgcgtattcgtttctcggtcggcctccatcacgactaacttagtttaagttcgggtacggtaccgttcggggtccccgacccgtacggtccccgtacggaacgggtaaacggacgggcgttaggggaaggttacggggtaggttacggggggactaacgttaccgttaaacgtccgaacggttaacccggggacgacccgtaaacccgtaaaccttaaccgaaccgttccccgttaccctaacgaacggtacggtaccgtaaccgtaccgtaaccgtaacgttacttacgtaacgtaacgaaccgtaaccggtaaccgtaaaccctaacccgtacgttacccgttacccggtaaggtaaccgggttccgtaacccgttcgtacggtacccggtacccggtaccgggaccggtaacccgtaccgggttacccgttaccgttacgttacccgtgggtaccggtaccgggtaccggttacgtttaccggaacgggtacgggaacccggtacgtaaccgttactaacgtcggtaccggtaccggg

SEQ ID NO: 144876 - DNA, 931 bp, Homo sapiens
  misc_feature: GYAE6OF01CV4PH.5.23.C01.1.454.CMB.1.raw
tcagatcagacacgcacgaccggtgctcgatttagtacacgtgattagggattgggcacgaccggtgctcgatttagtacacgtgattagggattggggatacttttctgagactcatggaccctcctgcacaagaacatagaacacctgtgttcctcctcctctggtggcagcctcccagagtcgggcccttgtctcgaggtcgacagcctggacgagggtcggtcccggggacccgagggtacgttgggtacggaaccggtcccggtttaccgggggtaccccgttcgtacccctccgtaccgttcggcgttacgtttcggttttccgtcggttcggtcccttacccgtataccgacgtacttaacctttaagtttaacggtttgggtaccggtaccggttccgggtcccgacccgacccggacccccggtaaagggaacggtcgggtcggtaggggtacggttagggtagggttacggggagttacgttaacgttacgttaccggtaaaccggttacccggggaactaacccgtaacccgtaaaacccgttaaccgtaaaccgttaccccccgttacccgtaacggtaaacgtacgggttaaccgtaaccgtaccccgtaaccttaacgttacttaaccgttaacggtaaccgaaccgttaccggtaaccaaaccccgttaaaccgttacccgttacccgttaacccgttaacgggtaaccgggttaccgtacccttccgggttaccgtaccccgggtaccccgggtacccgggtaccggtaacccggtaccccggttaccttaacggtttccgttaacggtcggttcgggtacccggttaggttacgttaaccgggagggtaaccgggacccgttaaggtaacccgtttaacgttaccgttaggtaccccggtagggttaccggggg

SEQ ID NO: 144877 - DNA, 987 bp, Homo sapiens
  misc_feature: GYAE6OF01C4YWL.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggaccctcctgcacaagaacatagaaccaccttgtggttccctcctcctccgtggtgcagcctcccagcgtcgggccctgtctcgaggtcgcacgctgcgaggtacggtccgggacccgaggtacgtacgggtacgaacggtccccggttaccggggaccccttcgtacccctcgaccgtggtaccgtgttcgtttccgtcggtccggtccctccgtatccgacgtactaacgtttaattaacggttgggtaccgaaccggttcgggtcccgacccgtaacccgggacccccgtaaggggaaacggtcggtaccggtagggacgggttcggggtaagggttggggaacgtacgttaccttaacgtacgaaccggtacccggggaactaacccgaaacccctaaacgttaccctaacccggttcccccgtacccgttaaacgaacggtcggtaccgtaaacggtaccctaaaccttacttaaccgtacgttaacgtaaccgtaaacccggacccgtaacccgtaaaaccgtaaccccgttaccgtttacccgtaacccggttaacggttaaccggttacccgtaccccggtttacgttcccggggtaaaccccggtcccccgggtacccgggtaaacccgggaacccccggttaacccggggttcccgttttaaacccgttaacgggttttaacccgcggggttacccgtaaccgggggtttcccggttttaaaacccgttacgggggtaaaacccggggaacccgggggtttaaaccaaaacccggggtttttaaaccccgtaacccggtttaaaagggttttaaccccgggaaccccgggggtttaacggggttaaacccccggggggg

SEQ ID NO: 144878 - DNA, 782 bp, Homo sapiens
  misc_feature: GYAE6OF01BQNWQ.5.23.C01.1.454.CMB.1.raw
  modified_base (144)..(144): a, c, t, g, unknown or other
  misc_feature (144)..(144): n is a, c, g, or t
  modified_base (194)..(194): a, c, t, g, unknown or other
  misc_feature (194)..(194): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacncctgtgttcctcctctctggtgcagctccagagtggccctgtctgaggtncagctgcgaggcgtccgggccaggctaggtgaacggtccggttccgggaccctcgtccctactaccgtgacgtacgttcgtttccgtcggttcggtacctcctatccgtacgtacctaaccgtttaagtttaacgttcggggtaccggtaccggttcccggggttaccgaccccgaacccgggtacccccgaaaggggtaaaccgtcgggtaccggtagggtacggttagggttaacgggttggggtaaatcgttacgttaacgtaccggtaacggtaccggggtaacacccgtaacgtaaacctacctaaccgtcccgttacctacgaacggttacgtaccgtacgtaacacccgtattaacctacttaacgtaacgaacctaaccggtaacgtaaccgtaaccctacggtttaccctaccgtaacggtgttaccgttaacgtcgttacggtcccggaccggtccggaaccggtaccgtacggtacccgtttacgtaacgtttaccgttcggaccggttcggtacggtttattacgggacggttacggaacggtacgtactagtaactgtacccggtggtcccgggg

SEQ ID NO: 144879 - DNA, 776 bp, Homo sapiens
  misc_feature: GYAE6OF01C15GQ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacaccttgtcggttcctcctcctccgtggtggcacgctcccaggatcgggcccctgtcgtccgaggtcgccagccgtggccgtaagggacggtccggggacccgagggtaccgtgggtacggaacggtcccggttccgggggacccttcggtcccctcgacccgtgtacgttacgttcggtttccgtcggtacggtccttccgactccgacgtacctacgttaagtttaacggttcgggtaccggtaccggtccggggtcccgtaccccgacccggtacccccggaaagggtaaaccggtacgggtacggtacggggtacggtaggggtaggttacggggaactagttacgtacgtacgacggtaaccgggacgaccgaaccgtaactaccgtaacgtcccgtaaccctacggaacgtacgtacgacgtaccaactaactacgttactaacgtacgaacctacgtaacctaacgtaaccttacgtaccgtaccgtagtaccggtacgtaccgtctcggtaccgaccggccggacggaccgtcggccgttaatcgttacgcggtcgacgggtccgtagttcggaagggtacggaactacggtaaccttaaggtcgtaacggtcgtaacgggtcggg

SEQ ID NO: 144880 - DNA, 798 bp, Homo sapiens
  misc_feature: GYAE6OF01DP31Y.5.23.C01.1.454.CMB.1.raw
tcagatcagacacgcacgaccggtgctcgatttagtacacgtgattagggattgggcacgaccggtgctcgatttagtacacgtgattagggattgggatactttctgagactcatcggacctcctgcacaagaacatgaacacctgtgtcctcctcctcctggtgcacgctcccagacgtcgggccctgtctcgaggtgcagctgcgaggacggtcggaccgaggacgtggtagacgtccgttccgggacctcgtccctcaccgtgcgtagttcgtttcgtcggtcggcctaccgtactacgacgactaacttaagtttaggttcgggtacggtacccggttcgggtccccgacccgaacccggtacccccggaaagggtaaacggacgggtcggttacgggaacggttcggggaagggtttaggggaacgtacgttacgttaacgttaccggaacggttaacccggggaacgtacccgtaaaccgtaaaccgtaacctaaccgttcccccgtaacctacgaaacggtacgtaccgtaacgtacccgtaactaactacttaacgttaacgtaacgtaccgtaaccgtaaccgtaaacctaacccgttacgtttaccctacccggttaaggtaaccggtaccgtacccgttcgtacccggtacggtaaccccggccggtaccgggtacccgtaaccggtcccgttacgttaacgttacgtcggtacggtcggttacgtacttaccgggaggtaaccgggactacggtaccttaacgtagtacgtccggtcgtccgggg

SEQ ID NO: 144881 - DNA, 535 bp, Homo sapiens
  misc_feature: GYAE6OF01CGR4J.5.23.C01.1.454.CMB.1.raw
  modified_base (102)..(102): a, c, t, g, unknown or other
  misc_feature (102)..(102): n is a, c, g, or t
  modified_base (504)..(505): a, c, t, g, unknown or other
  misc_feature (504)..(505): n is a, c, g, or t
  modified_base (507)..(535): a, c, t, g, unknown or other
  misc_feature (507)..(535): n is a, c, g, or t
tcagatcagacacgcacgaccggtgctcgatttagtacacgtgattagggattggggagatctatcataccgggagcaccaactacaatccgtccctcaagngtcgagtcaccatatctatagacacgtcgaacaacagttctccctgaagtgacctctgtcgacgccgcgacacggccgtctattactgtcgcgcggtattcgaggacggacgacggactactatagtcgtacgtcgtgggcagggacggaccacgtcagtcgtctccgtcgaccgtccgtaccgaacggaccggtccctaccgttccggttccccgttccccgtccgtcccctacccctaccgaccgacgaccgaccgtaccgtcggtccggggaccacggaccggcccggtccgtcggtcgtccggtaccgtacggtaccgtaacggttaccgttacccgttccgtcgtacgtacgtacgtcggtaggacgggcggcggtacggacgacggcgtacgagtnntnnnnnnnnnnnnnnnnnnnnnnnnnnnnn

SEQ ID NO: 144882 - DNA, 836 bp, Homo sapiens
  misc_feature: GYAE6OF01CDFDF.5.23.C01.1.454.CMB.1.raw
  modified_base (146)..(146): a, c, t, g, unknown or other
  misc_feature (146)..(146): n is a, c, g, or t
  modified_base (207)..(207): a, c, t, g, unknown or other
  misc_feature (207)..(207): n is a, c, g, or t
tcagatcagacacgcacgaccggtgctcgatttagtacacgtgattagggattgggcacgaccggtgctcgatttagtacacgtgattagggattggggatactttctgagactcatggaccctcctgcacaagaacatagaaacncctgtcggttccctcctcctcctggtggcagcctcccagagtcggccctgtctcgaggtcncagtctcggcgagggacggtccgggacccagggtaccgtgggtacgaacggtccccggttaccggggaccccttcggtccccctactaccgtggtacgtacttcggttttccgtccggtcggtccttacccgataccgacgacctaaccgtttaagttaacgtttcggggtccggtacccggttccggggttaccccgccccgtaacccggaccccccggtaagggaaccggtacggtcggtacgggtaggtagggttaggtacggggtacgtacgtctaacgtacgaaccggtaccgggaacgccctaaaccgtaacctacctaacccgttcccgtaccctaacgaacgtacgggtacgtaaccgtaccgaacctaagttaacctacgttaaagtaaccgtaaccgtaaccggtaacccaaaaccgttaacccgtaccgtttacccgtacccggtaaggtaaaccgtacccgtaaccgttccgtaccggtaccggaccccgggttcggaccggtaccgtaaccccgtccgttactaccggttccgtacgtccgacgggtcgttacgttacggaagggtaccggaacgtacgtaccttaactagttacccggtacgaccggttacgggg

SEQ ID NO: 144883 - DNA, 913 bp, Homo sapiens
  misc_feature: GYAE6OF01CB98Z.5.23.C01.1.454.CMB.1.raw
  modified_base (123)..(123): a, c, t, g, unknown or other
  misc_feature (123)..(123): n is a, c, g, or t
  modified_base (181)..(181): a, c, t, g, unknown or other
  misc_feature (181)..(181): n is a, c, g, or t
  modified_base (204)..(204): a, c, t, g, unknown or other
  misc_feature (204)..(204): n is a, c, g, or t
tcagatcagacacgcacgaccggtgctcgatttagtacacgtgattagggattgggcacgaccggtgctcgatttagtacacgtgattaggattggggatactttctgagactcatgacctcngcacaagaacatagaactaccgtgttcggtcctcctcctcgtggtagcagctccgagngtcggccctgtcacgaggtgacngcgtgacgagggcggccggtaccgaggtacgtggtacgaaccgtcccggttaccgggccctacggtcccctactacgtcggaccgtagttccgttccggtccgtcgtccgtacctactcgaacgaccgttaacttaagttacggttcggggtaccggtaccgggttccgggtacccaccccggaacccggacccgggaaaggacgggtacggtaccgggtagggtacggtacggggtaagttcggggaacgttacgtacgtacggttaccgaacgggttaccgggaactaaccgaacccgttaaaccgtacgtaacccgtaccccggttacctaacggacgtacggtacgtaaccgtacctaaccgtaactaacgttacgtaaacgtaccgggttaaaccaccggtaaccgtaaacccttcccggttaaaccgttccccgttaaccggttaacggttaaccggtttccccgtaacgttcccggggttaaccgtaacccccgggtacccgggttacccggacccgggttaaccggaccccgggtttcccgttaaagtttacccgtccgggttacccggaccgggggttaaccggtttaccgggttaacggttaccccgggaagggtttacccgggaaaaccgtttcccggggttaaaaccttaaccgggttacgtttaaaccccgggtccggtaggggttaacccggggg

SEQ ID NO: 144884 - DNA, 950 bp, Homo sapiens
  misc_feature: GYAE6OF01DRO3S.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatcggacctcctgcacaagaacatagaaaccacctgtgttcctcctctcctggtgcagctccgagagtcgggccctgtctcgagggtcacgagtccgtgaccggtagggacggttcccggggacccgtagggtaccgttgggttacgaacccgtccccgggttaccggggtacccccttgttaccccgtacctaccggtagtccgtacgtttcggttttccgtccgggttccggtcccgtaccctacgtaccgtaccgtacgttaaccgtttacgtttaaagggtttcggggtaccggtaaccggttccgggtccccggaccccgtacccgggacccccgtaaagggaaaccggttacgggacggttacgggtacggtacggggttaacgggttacgggggtaattacgttacgttaaccggtacgttaaccgggtaacccgggtaccgaaaccgtaaccccgtaaccgtaacccgttaaaccggtcccccgttaaccgtaaaccgtaacgggttaccggtaccgtaaccgtacccgtaaccgttaacgttaaccgtttaacgtaacgtaaccgtaaccgtaaccggtaaaccgtaaacccgtaacccgttacgtttaccccgttaacccggttagggaacccgttaccgtaacccgttggttaaccggaccccggtaacccgggacccggtaccggtaaacccgtacccggttacccgttaacggtttaccgttaacggtccgtacgggtacccgggtcgttttaagttcgggaaccggttaacggggtaccaaggttaccctttaagtaacgttccgcgggtacggtaccggg

SEQ ID NO: 144885 - DNA, 759 bp, Homo sapiens
  misc_feature: GYAE6OF01EXGXC.5.23.C01.1.454.CMB.1.raw
  modified_base (715)..(715): a, c, t, g, unknown or other
  misc_feature (715)..(715): n is a, c, g, or t
  modified_base (744)..(744): a, c, t, g, unknown or other
  misc_feature (744)..(744): n is a, c, g, or t
tcagatcagacacgcacgaccggtgctcgatttagtacacgtgattagggattgggcacgaccggtgctcgatttagtacacgtgattagggattggggatacttttctgagactcatcggaccctcctgcaacaagaacatacgaaaactaccgtgttcggttccctcccttccttccgttgggtcggaccacgtcctcccgagagtcgggcctgtctcgaggtgcgagcgtggacgcgggtacggtccgggccaggtacgttggacgtaaccggtcccggtttccggggacccttccggttaccctcccgaccgttcggacgttacgtttccggtttccggtcggtacgtcctaccgtacgtaccacgttactaacgttttaaggttacgttacgggtacggtaccgggtcccggtcccgaccgacccgacccggaaaggaacgggacgtcggtaggaggtaggtagtagggatagtcgtacgtacggtacgacggactaccgaaacctaacgtacctaccgtaccctaacgtacgtaacgcgtacaccgtaacctacctagttactcgttaacgacgtacgtaacgacgaaccgtacgtaaccttccggacgtacgtaaccgttcgtcgttcgaccggccgaccgtccggaacggtcgaccgttaccgttacagttacgttgaccgtacggttccgtaggttcgaaacgggngtaaccggacttaacgtcgtagtacccgngggtcccggttaggg

SEQ ID NO: 144886 - DNA, 917 bp, Homo sapiens
  misc_feature: GYAE6OF01CIXWE.5.23.C01.1.454.CMB.1.raw
  modified_base (204)..(204): a, c, t, g, unknown or other
  misc_feature (204)..(204): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttccctcctcctccgtggtgcagcctccagagtcgggccctgtctcgaggtncacgctgcgaggtcggtccgggcccaggtcgtggtacgacgtcccggttccgggaccctcgtccctcgtaccgtgtcgtactttcgtttccgtccggtcggtcctacccgtagtaccgaacgtaccttaacgtttaagttaaggtttcggggtaccggtacccgggtttccgggtcccccgacccggaaccccggtaaccccgggaaagggaaacggtaccgggtacggttaggggtacgggttacggggtagggtttacgggggaacgttacttaccgttaacgttaccggaaaccgggttaccgggaaccgtaacccaaacccgttaaaacgtaacccgtaacccgttaccccggttaaccccgtaacggtaaacggttaccggtacccggtaaaccttaccctaaacccgttaatttaaccgttaaccgttaacgttaaaaccgaacccgttaaccggtaaaacccgaaacccgttaacccgttacgtttacccgtacccgtaaggggtaccgttacccgtaccgttccgtaacgggtaccccgacccgggtcccgggtaaccggacccgtaacccgggttccctttaaccgttacgttccggtacgggtcccggaccgggttaaccgttacgttaacgggaacgggtaaccggtaccgtaaccggtaacctttacgttaacgtaccggtacccgggtagtacccggggg

SEQ ID NO: 144887 - DNA, 705 bp, Homo sapiens
  misc_feature: GYAE6OF01AVT6J.5.23.C01.1.454.CMB.1.raw
  modified_base (296)..(296): a, c, t, g, unknown or other
  misc_feature (296)..(296): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctctggtgcagctccagatgggccctgtctcaggtcgcagctgcagggacggtcgggacccaggacgtggtacgaacgtccgttccgggaccctcgtccctcaccgtgcgattcgtttctcgtcggcctcactcanctaatattaagtggtcggaccgtggtaccgcccgacgaccccgaaggaaacggacgtacgtgggagtaggggtagtaggggactagtacctagaccaaggtacccggacgaacaacccaaactaaccaacgttccccgtacctaactaacggacggtaccgtaacgtacctacctaagtacttacgtaacgtaacgaaacgtaaccgaacgaaacctaacccgtacgttacccgtaaccgtacgtaacgggtctacgtaccgttggacccggaaccggccgaccggtacgaaccgggtccttacgtaacttcgaggtaccgacggtaccggtaagtttacgaagggtaaacgggacctaaacgggtaactttaacggtaaacttacgtaccgggttaccgtaccggggg

SEQ ID NO: 144888 - DNA, 821 bp, Homo sapiens
  misc_feature: GYAE6OF01DA4JE.5.23.C01.1.454.CMB.1.raw
tcagatcagacacgcacgaccggtgctcgattttagtacacgtgattagggattgggcacgaccagtgctcgatttagtacacgtgattagggattggggatactttctgagactcatggacctcctgcacaagaacatgaaacacctgtggttcctcctcctcctggtgcagctcccagatcgggccctgtctcgaggtgcagctgcgaggacggtccgggccgaggtacgtgggtacgacggtccggttccggggaccctcgtccctcactcgcgtattcgttctcgtcggtctccgtatacacgctacttatttaagttcgggtacggaccgttcgggtacccgaccgtaccggaccccgaagggaaacggtgggtaccgttgggaacgggttgggtagggtttacggggagttacgttacgttaacgtacgaacggttaacccgggaacgaccctaaacccgaaactttaccgaacgtttccccggtaccctaacgtacgggtaacgttcccggaacgttaccaaacctaacgttaacttacttaacgtaaccgaacctaaccgttaaccaacccgtaaacccgttacgtttacccggttacccgtaacgggtaacggttaccgacccgtttaccgtaccgggtaccggaccccgggttccggaaccgggtacccgtaccgggttcccttaacgtttaacggttacccgttaggtccggacggttaccgggttacgtttacggggaacggtaaccgggttaaacgaacccgggtttaaacttaccgtttaaacgtacggttacccggttaaccgggg

SEQ ID NO: 144889 - DNA, 700 bp, Homo sapiens
  misc_feature: GYAE6OF01EMRP4.5.23.C01.1.454.CMB.1.raw
  modified_base (386)..(386): a, c, t, g, unknown or other
  misc_feature (386)..(386): n is a, c, g, or t
  modified_base (664)..(667): a, c, t, g, unknown or other
  misc_feature (664)..(667): n is a, c, g, or t
  modified_base (669)..(672): a, c, t, g, unknown or other
  misc_feature (669)..(672): n is a, c, g, or t
  modified_base (674)..(683): a, c, t, g, unknown or other
  misc_feature (674)..(683): n is a, c, g, or t
  modified_base (685)..(685): a, c, t, g, unknown or other
  misc_feature (685)..(685): n is a, c, g, or t
  modified_base (688)..(693): a, c, t, g, unknown or other
  misc_feature (688)..(693): n is a, c, g, or t
  modified_base (696)..(700): a, c, t, g, unknown or other
  misc_feature (696)..(700): n is a, c, g, or t
tcagatcagacacgcacgaccggtgctcgatttagtacacgtgattagggattgggcacgaccggtgctcgatttagtacacgtgattagggattggggatacttttctgagactcatcggacctcctgcaacaagaacatagaaacacctgtgttcctcctcctctggtgcagcctcccgagagtcggccctgtctcgtagggtcgccagtcgtggcgagggacggtccgggacccgaggtacgtgggtacgacggtccccggttccgggacctccgtccctaccgcgtcggcgtacgtttcgtttccgtcggttccggtcctaccgtactacacgtaccttacgttactttaggtttcgggtacggtacccgtccggggtcccncccgaacccggaccccggaaggaacggcggtacgtagggtaggttacgggagggttacgggaacgtacgttacgtaacgtaaccggtacggtaacccgggaactaaccccgaaaccgtaacccttaaacccgtaacccgtaccccgttacccgtaaacgtaaccggtacggttaaccgtaaccgttaaccctaaccgttaacgttaacgttaacgtaaacgttaaaccgtaaccgttaaacccgtaaacccggtaaacccgtaaaacccccggttttnnnnannnngnnnnnnnnnnangannnnnncannnnn

SEQ ID NO: 144890 - DNA, 672 bp, Homo sapiens
  misc_feature: GYAE6OF01BE1ID.5.23.C01.1.454.CMB.1.raw
  modified_base (144)..(144): a, c, t, g, unknown or other
  misc_feature (144)..(144): n is a, c, g, or t
  modified_base (204)..(204): a, c, t, g, unknown or other
  misc_feature (204)..(204): n is a, c, g, or t
  modified_base (511)..(511): a, c, t, g, unknown or other
  misc_feature (511)..(511): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacncctgtggttcctcctcctcctggtggcagctcccagagtcgggccctgtctcgagggtcncagctggcaggcgtccggccaggacgtggtacgaacgtcccgttaccggggacctcgtccctcctacgtgcgtagttcgttcgtccgtcggccttaccagtcacggtactacttaagttacgttggtacggtaccgtcgggtcccgacccgaccggaccccgaaggaaacggcggtacgtagggaggtagggtagttaggggacgtacttcgtacgtacgaacggtacgggaccaaccgtaacgtaaccctacgtaaccgtccccgtacgtacgaacgtagtacgctaccgaactctaagtctaacncgaacacgttaaccgaacctacttacgtaccgtacgtaagacggttacacgtccgtacgcgtaccgccgacggtaccgaccgtcgtcctacgtacgtcggcgtccggtacgtgttacggagacggtaacgacgtaccagttacgtactcggtcgtaacggg

SEQ ID NO: 144891 - DNA, 776 bp, Homo sapiens
  misc_feature: GYAE6OF01DHOX1.5.23.C01.1.454.CMB.1.raw
  modified_base (267)..(267): a, c, t, g, unknown or other
  misc_feature (267)..(267): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtgttcctcctctcgtgtgcagctccagctcggccctgtctcgaggtcgcagctggcagggacggtccgggccctaggtaccgtgggtgaacgtcccggtttccgggaccctcgttacccnctacgtgtcgtattcgttccgtcggtcggtcctcctagtccacgtactacttaacgtttagttcgggtaccggtaccggttaccgggtcccggaccgtaccgaccccggaaagggaaacggcggtacggtagggtacggtaggtacgggtaggggtacgttacttcgtaacgttaccgtaccggtaccggggaacaaccgaaccctaacgtacgtaacctcccgtaccctacgacgtcgtaccgtactacaaccttagtactacgttaagtaacgtaacccgtaacgtaaccgtaaacctaccttaaccgttccgtaacccgttaggttaacgttccgtaacccgttcggtcggttaaccggccgggaccgggtaccggtaacccggtacccggtccgtttaacttacgttttacggccggttggtaccgggttccggttaagttcccggggaaggtaccgggtaacgtacgtaacgttaacgttacgtacgtcggtcggttaccgggg

SEQ ID NO: 144892 - DNA, 950 bp, Homo sapiens
  misc_feature: GYAE6OF01CL87S.5.23.C01.1.454.CMB.1.raw
  modified_base (937)..(937): a, c, t, g, unknown or other
  misc_feature (937)..(937): n is a, c, g, or t
tcagatcagacacgcacgaccggtgctcgatttagtacacgtgattagggattgggcacgaccggtgctcgatttagtacacgtgattagggattggggatactttctgagactcatcggacctcctgcacaagaacatacgaaacacctgtggttcctcctcctccgtggtggcacgctcccagacgtcgggccctgtctcgaggtcgcgagcgtcggaccgagggacggtccggggacccgtaagggaaccgtgggtacgaaccggtcccggttacccgggggacccttcggtccccgtccgtaccgtcggtaccgttacgttcggttttccgttccgggtaccggtcccttacccggtaacttccgaaccggtaccttaaccgttaaacgttttaaacggtttcggggttaccggggtaaccccggttccgggggtacccccgacccgtaacccgggaaccccccggtaaaggggaaaacggtacgggtacccgggttagggtaacgggttacggggtaacgggttttacgggggaaacgtacgtttaaccggtaacgttacccggtaacgggttaaaccccggggtaacgtaacccctaaaacccggtaaaacccgttaaacccgtaaaaccgtttccccccggttaccccgttaaacgggaaaccgggttaccgggttaccgtaaaccggttacccgaaacccgttaacttaacgttaaacccgttaacgtaaccggtaaacccgtaccggtaaccgttaaaccgaacccgttaccgttacccgtaccgtaacggtacggttacctaccgttcgtacggtaccgacccggtccggaccgaccgtaccggtaccgtacttacggttacgtaccggtcggaccgtacggttattacgggacgggacggtaacgacggtaactactagttacggngtcgggtaccggg

SEQ ID NO: 144893 - DNA, 791 bp, Homo sapiens
  misc_feature: GYAE6OF01BEFAQ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagcctcccagatcgggccctgtcctcgaggtgcagctgcgagggacgtccgggccaggtacgttgggtacgaaacggtccccggttaccggggaccccttcggttaccccctacgtaacccgttggccggttaacgtttcggtttttcccgtccggttacgggtccccttaccgtaaccgttaccgaacggtcctaaaccgtttaaggtttaaacgtttcggggtaccgggtaacccgttccgggggttaccccgacccgtaaccggaccccccgaagggaaaacggtacggtaccggtagggtacggtacggtaggttacggggacgtaacgtacgtactacgtacggtaccggacgacctaaccaaccgtaacgaaccttccccggtacccgtacgaacgtacgtacgacgtacctactacttatcgtaactacgaacctacgtaaccgaacctaacctccgttaccgtaccgtagtaccgtacgtacccttagaccgtacgacccgtcgggacccgtacgtaccggtctaccgtaagttaccgtgtccgccggtagttacgttacggacggaacggtacgaacgttacgacgttaagtccctaacggtggtacccggg

SEQ ID NO: 144894 - DNA, 792 bp, Homo sapiens
  misc_feature: GYAE6OF01ETDXY.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatcggacctcctgcacaagacatacgaaacacctgttcggttacctcctcctccgtggtgcagctccagatcggcctgtctcgaggtcactacgctgccgagggtacgtcggacccaggtacgttaggtacgaacgtcccggttaccggggacccttacgtcccgtacaccgtacgcgttacgttcgtttaccgtccggtacggaccttaccgatccaagccttaacgtttaagtttaagtcgggtaccggtaccggttacggggttaccccgaccgtaacccggaacccggaaacggtaacgggacggttacggtagggtaacggtaggggttacgggtagggtaacgtaacgttacgtaaccgtacgtaacgggtaaccgggactaaccgaaaccctaacgtaacccgaaccttacccgtaacccgactaaacggtacggtacgtacgtaccaacgtactaactacgtactaacgtacgaacccgtaacgaaaccgtaccgttaacgttaacccgttacggaacgtaacgtaccgtacgtacggtagtaccgacgggtacccgtacggaccgaccgtctaacttcgtacgtagtcggtacggtaccgttaggttacggaacggtacggtaacgaaaccgtaacgtaacttaacgtagtcccggtacggttacggg

SEQ ID NO: 144895 - DNA, 789 bp, Homo sapiens
  misc_feature: GYAE6OF01DGV9E.5.23.C01.1.454.CMB.1.raw
  modified_base (770)..(770): a, c, t, g, unknown or other
  misc_feature (770)..(770): n is a, c, g, or t
  modified_base (775)..(775): a, c, t, g, unknown or other
  misc_feature (775)..(775): n is a, c, g, or t
tcagatcagacacgcacgaccggtgctcgatttagtacacgtgattagggattgggcacgaccggtgctcgatttagtacacgtgattagggattggggatactttctgagactcatcggacccttcctgcacaagaacatacgaaacacctgtcggttcctcctcctccgtggtcggcagcctccagacgtcgggccctggtctcgaggtcgcgacggctgacagggacggtcccggggacctagggacgtgggtacgaaccgttcccgggttaccggggtaccccttcgtaccccgtacgtaccgtaggtccgtacgtttcgttttccgacggttccggtaccctacctcttacgacgtacctaagtttaacgtttaacggttcgggtaccggtacccggttccgggtaccccgaccggtaacccggaccccggtaaagggaacggtcggtacggtagggtaacggtagggtacggttaggggaatacggttacgttacgtacgtaaccgggtaaccggtaactacccgaaaccgtaaaccgtaaccgtaacccgtacccgtaaccttaacgaaggtaccgtaacgtaccgtacacgttactacgtaacgtaacacgtaacaccgtaaccgtaaccaccgtttactcccgttacggaaggtaccgtccgttactcggacggtccgacggtacccgacggaccgtaccggtactacttacgtcgacgttacggaccggtacttacgtaggacgacggacttaacacgtntacgngtcccggagtcggg

SEQ ID NO: 144896 - DNA, 763 bp, Homo sapiens
  misc_feature: GYAE6OF01AYH32.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtcggttcctcctcctcctggtggcagctcccgagagtcgggccctgtctcgaggtgcagctgcaggcggtcgggcccaggacgtggtagaacgtccgttccggggaccctcggtccctaccgacgtcgcgtattcgtttcgcgtcgtctcctatcacgctaacttagttagttggtcgtaccgtcggtccgccgaccgaccccgaaggtaaacggcggtcgtagggtacggttacggggtacggttaggggaactacgttacgtacgtacggtaaacggtacccgggaacgttaacccgaaaccggttaaacctaaccggtaaaccgttccccggtaccctaacgaaacggttacgtaccggtaacgtacctaaccgtattactaacgttaacgaaccgaaccgttacccggtaaccgaaactaccccgtttagttacccctaccggttaaggaaccggttccgaaccgttcggtaccgtacccggaacccgggtacccggtaccggaccgttacccggacgtttacttaacgttccgtacggtcggtaccggtcgttacgtacggaggtaaccggaagtaccgtaactacttaagtcgtacggtcggtacgggg

SEQ ID NO: 144897 - DNA, 742 bp, Homo sapiens
  misc_feature: GYAE6OF01BL07L.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagacatgaacacctgtggttcctcctcctcctggtggcagcctccgagatgggccctgtcctcgaggtcgcagctggcgagggacggtccggggcccagggacgtgggtacgaacgtccggttaccggggaccctcgtcccctcaccgtggccgtattcgtttccgtcggtcggcctaccgtatcgagacctacgttaagttaagttcgggtacgggtaccgttcgggtcccgacccgaaccgacccccggaagggaaaacgcgggccgttagggaggttacgggtaggttacggggatacgtcgtacgtcgaacggtaccggggactaccaaccgaacgtacgaccgttccgaccctacgaaggtacgtacgtacgtccaaccgtatactactaagaacgaccgtaacgtaccgaaacgttaacccgtacgtttacccaccgttacggtaacggttccgtacctcggttacgtaccggtaccccgggcccgtaaccggaccgacccggttccgttaacgtcgttaccgtacggtccgggacggtccgttaagttcggaggtacggtaaccggacggtacttacgtagttaccggtcgtcggttaccgggg

SEQ ID NO: 144898 - DNA, 776 bp, Homo sapiens
  misc_feature: GYAE6OF01CZSKB.5.23.C01.1.454.CMB.1.raw
  modified_base (768)..(768): a, c, t, g, unknown or other
  misc_feature (768)..(768): n is a, c, g, or t
tcagatcagacacgcacgaccggtgctcgatttagtacacgtgattagggattgggcacgaccggtgctcgatttagtacagtgattagggattggggatactttctgagactcatggaccctcctgcacaagaacatagaaacacctgtggttcctcctcctctggtggcagcctcccgagagtgggccctgtctcgaggtgcagctgcgaggacgtcgggacccaggcgtggtcgaacgtcccggttaccgggaccctcgtccctcaccgtagcgtagttcggtttcgtcggtcggccttccacgtccacgactacgtttaagttaagtttcgggtaccggtacccgtacgggtcccgtacccgaacccggaacccccggaagggaaacggtacggaccggtagggtaacgggtagggtacggttaggggaacgtacgttacgtaacgttaccggaacggttaaccggggaccgtaacccgtaaacccgtaaaccgtaaccgtaaccggttacccccgttacccgtaaaccgtaaacggtacgtaacggtaaccgtaccgtaaaccgtattaaaccgttacgtaactaaccgaaccgtaccgtaaccaaaccgttaccgtaccgttccctacccggtaagtacgtacgtacccgtcgtaacggtaccggacccggaccgtaccggaccgtaaccgtccgttacttacgtcctacggtcgtcggtacgtacgtacggaggaacggtacagtaactatagacctcggngtaccggg

SEQ ID NO: 144899 - DNA, 780 bp, Homo sapiens
  misc_feature: GYAE6OF01BGYP0.5.23.C01.1.454.CMB.1.raw
  modified_base (231)..(231): a, c, t, g, unknown or other
  misc_feature (231)..(231): n is a, c, g, or t
  modified_base (451)..(451): a, c, t, g, unknown or other
  misc_feature (451)..(451): n is a, c, g, or t
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
  modified_base (772)..(772): a, c, t, g, unknown or other
  misc_feature (772)..(772): n is a, c, g, or t
tcagatcagacacgcacgaccggtgctcgatttagtacacgtgattagggattgggcacgaccggtgctcgatttagtacacgtgattagggattggggattactttctgagactcatcggacctcctgacaacaaagaacatacgaaacctaccgtgtcggttccctccttcctccgtgggtcggctacgtccgtaccgaggacggttccgggtccttgtctcgaggtcncgtacgtcgtacgggacggtaggggtaccgggtcccgggaccgtagggtacggtacggggttacggaaccgggtttccccgggttcccgggggtacccttccgttcccgtaccgtaaccggtcggtacggtttacttttccgggtttcccgtcgggtccgtccgtacctacgtcacgtacttaacgtttaggttacggttcgggcggtaccgtccggccnccgaccgacggaaggacgngtcgtacgggnggtggtaggtcggatacgtcgtacgtacgtacgaccggtaccaactaacctaacgttacccgtaccgtcccgtacaacggtacgtccgtacgtaactacctaacgttaactcttaacgtagtaaccgtaaccgtacgttaaccaaccttaccgtaccttaccgtaccgtggtacgtaccgtctccgacgtcccggaccggcccggtaccgcggtccgtactccgtacgtcgtcgtacggtacgtcgtacggtaggcggtaagaccgtacggtactacttaccggagtcggnggtacggg

SEQ ID NO: 144900 - DNA, 796 bp, Homo sapiens
  misc_feature: GYAE6OF01BAXKM.5.23.C01.1.454.CMB.1.raw
  modified_base (660)..(660): a, c, t, g, unknown or other
  misc_feature (660)..(660): n is a, c, g, or t
  modified_base (780)..(780): a, c, t, g, unknown or other
  misc_feature (780)..(780): n is a, c, g, or t
tcagatcagacacgcacgaccggtgctcgatttagtacacgtgattagggattgggcacgaccggtgctcgatttagtacacgtgattagggattggggatactttctgagactcatcggacctcctgcacaagaacatagaacacctgtcgttcctcctcctccgtggtgcagcctccagtacgtcgggccctgtctcgaggtcgctagcgtgacgacgggacggtcccgggacccgaggtactgggtacgaacgtcccggttccgggacccttcgtacccctacgccgtcggcgttactttggtttccgtacggtccggtcctacctacgtaccacggtacttaactttaacgtttacggtcggggtcgtacccggttcggggtacccctaccgaacccggtacccgtaaagggacggacgtcggtagggtaacggtaggttacgggtagggacttacgtacgtaactaccgggaccggtaccggaaccgaaccgtaacccaaacgttaccgaacccgttccggtaaccgtaagtaacggaacgttccgtaacctacccaacgttactttaaccgactaaaccggccgtaaacctaccggtaactaaacccgttaacgttccgtaccctacggacgtaccggccttatccggtaaccncccggaccggtcccgacgacccgttaccggtacgttaacttaccgttcggaccgagttccggttacggtatacccgggaaggttaacggacctttagaccttaccgtaagttaacccggngggttcgtaaacgggg

SEQ ID NO: 144901 - DNA, 741 bp, Homo sapiens
  misc_feature: GYAE6OF01B9S4T.5.23.C01.1.454.CMB.1.raw
  modified_base (145)..(145): a, c, t, g, unknown or other
  misc_feature (145)..(145): n is a, c, g, or t
tcagatcagacacgcacgaccggtgctcgatttagtacacgtgattagggattgggcacgaccggtgctcgatttagtacacgtgattagggattggggatactttctgagactcatcggacctcctgcacaagaacatgaaacncctgtcggttcctcctcctccgtggtggcagcctaccgagagtcgggccctgtctcgaggtcgcagtctcggccgagggccggtccgggacccgaaggtaccgtggtacggaccggttccccggttaccggggtacccctcggtcccctactaccgtggtaccgtactttcggtttccggtcgtcggtcctaccgtatcgacgtctaagttagttacgttcgggtacggtaccggtcggtcccaccgtacccgacccgaaggaacgtcggacgtgggtacgtgggtacggttagggaactgttacgtagacgtaccggtaccggataaccgaacctaacgtacctaccgcccgttaaccagacggtacgtacgactaccgaactactactacgtactacgaccgtaaccgaaccgtaaccaacccgttcgtacccgacgtacggtacggttccgaccgttcgtcggacccggtccgacggtccgaccgtaccggtccgttacgtcgtacgtcggtaccgtacggttcggtacgttacgggaagtaaccgggtacgaacggttactacgaacggttacggtccggtaaccggtcggg

SEQ ID NO: 144902 - DNA, 552 bp, Homo sapiens
  misc_feature: GYAE6OF01A5FTT.5.23.C01.1.454.CMB.1.raw
  modified_base (175)..(175): a, c, t, g, unknown or other
  misc_feature (175)..(175): n is a, c, g, or t
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (508)..(509): a, c, t, g, unknown or other
  misc_feature (508)..(509): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(552): a, c, t, g, unknown or other
  misc_feature (518)..(552): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaaccagttctcccgtgaaggtgacctctgtcgaccgccgnggacacggccgtctattactgtgcggnggatttcgagaggggacctaggactacgtatatcgacgtgtgggctacggacgggaccacggtcataccgttctcctccacgcccttaccgaccgtaacgggcccctagttccggttacccttcccccgtggccctaacccctcccgtaccaaggacgaccnccgtacgtcgggggacacgacgaccggtccggtcgggcctcggacccgtgggtaacaacgtaccgttacctccccggttagtcgtcgtactccgtgacgggcggtcgtaggaccgtaagggccgtcgaagtcgtcgngtcncgnngnngngngnnnnnnnnnnnnnnnnnnnnnnnnnnnnnnnnnnn

SEQ ID NO: 144903 - DNA, 935 bp, Homo sapiens
  misc_feature: GYAE6OF01B4SJ2.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatacgaaacaccgtgtggttccctcctcctcctggtggctagctcccgagagtcgggccctgtctcgaggtgcgagcgtggacgacggacggtccgggacccgagggtacgtggtacgtaaccggtcccggttaccgggggtacccttccggttacccctaccgtaccgtcggtacgttacgtttccggttccgtccggtcggtaccctacgtacgtaccgtaacgtaccgttaacgtttaacggtttaacggttacgggttaccggttacccgggttcccgggtaccccggtacccggaccccggaaccccgggaaagggaaccggtacgggtacgggtagggtacgggtagggttaacgggtacgggtacgttacgtacgtaacgtacggtaaccggtaacggtaaccgaacccgtaaaccgtaaccgtaaccgtaacccggttaccccgtaccgtaacggtaacggtaccgtacggtaccgtaacctaaccgttaacttacgttaacgtaacgtaaccgtaaccggtaacccgtaaccgtaaaccgttaacccgttaccgttacccgttaccggtaacggtaaccggttaccgtaccgttaccggtacccggtacccgggtacccgggtacccggtaaccggtacccgtaccggttaccgttacgtttacggttacggtacggtacccgggttaaccggtaacgggttacggttaacgggaaccgggtaaccggtaaaccggttaacgttaaccggttaacgttaaccggtccggtaccgggtaccgggtaccggg

SEQ ID NO: 144904 - DNA, 860 bp, Homo sapiens
  misc_feature: GYAE6OF01DOC6Q.5.23.C01.1.454.CMB.1.raw
  modified_base (778)..(778): a, c, t, g, unknown or other
  misc_feature (778)..(778): n is a, c, g, or t
  modified_base (845)..(845): a, c, t, g, unknown or other
  misc_feature (845)..(845): n is a, c, g, or t
tcagatcagacacgcacgaccggtgctcgatttagtacacgtgattagggattgggcacgaccggtgctcgatttagtacacgtgattagggattggggattactttctgagactcatggacctcctgcacaagaacatagaacacctgtggttcctcctcctctggtgcagcctcccagacgtcgggccctgtctcgaggtcgcagcgtgcgagggacggtccgggccgaggtacgtgggtacggaacggtcccgttaccgggggaccctcggtcccctcgtaccgtggacgttacgttcggtttccgtcggtcggtccttccgatcgacgtacttaacttagtttaaggttcggggtacggtaccggtccgggtcccgcccgaccggaccccggtaaagggaacggtacgggtcggtagggtaggtacgggtaggttaggggagttaacgtacgttacggtaaccggtaacgggtaacccggggtaacgaaccctaacccgtaaaccgttaacccgtaacccgttccccggttacccgtaaaccggtaaagggttaccggtaccggtaaccgttaccaaaccgttactaacgtttaactaaccgtaacggaaccgttaaccccgtaacggtaaaaccctaccggtttaaccggtttcccttaacccgggttaacggaagggtttccctacccggttcggacccgggttaccggccccggggtacgaaccgggttaaccacccgggtccttacgttaacgttcggtaggtcccgggngttacccgggttaagttccgggaacgggacggtaaccgaacgggttaaccttaacggtattaccggngggttaccgtcgggg

SEQ ID NO: 144905 - DNA, 402 bp, Homo sapiens
  misc_feature: GYAE6OF02HXZ7H.5.23.C01.1.454.CMB.1.raw
  modified_base (399)..(402): a, c, t, g, unknown or other
  misc_feature (399)..(402): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggcctgggctgcctggtcaaggactacttccgtgtctgatctgagcgggctggcaaggcgcatagnnnn

SEQ ID NO: 144906 - DNA, 404 bp, Homo sapiens
  misc_feature: GYAE6OF02IVTCW.5.23.C01.1.454.CMB.1.raw
  modified_base (402)..(404): a, c, t, g, unknown or other
  misc_feature (402)..(404): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcgggctggcaaggcgcatagnnn

SEQ ID NO: 144907 - DNA, 433 bp, Homo sapiens
  misc_feature: GYAE6OF02JAZ7B.5.23.C01.1.454.CMB.1.raw
  modified_base (417)..(417): a, c, t, g, unknown or other
  misc_feature (417)..(417): n is a, c, g, or t
  modified_base (419)..(433): a, c, t, g, unknown or other
  misc_feature (419)..(433): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggcaccctcctccaagagcacctctgggggcacagcggccctgggcctcgccgtggtacgaaggactaccgttcccgtgtctgtactctgaggcggcgtggacgagggcgctagtagngnnnnnnnnnnnnnnn

SEQ ID NO: 144908 - DNA, 406 bp, Homo sapiens
  misc_feature: GYAE6OF02H4NKK.5.23.C01.1.454.CMB.1.raw
  modified_base (404)..(406): a, c, t, g, unknown or other
  misc_feature (404)..(406): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaaagggcccatcggtcttccccctggcaccctccctccaagagcacctctgggggcacagcggccctgggctgcctggtcaaggactacttccgtgtctgatctgagcgggctgggcaaggcgcatagnnn

SEQ ID NO: 144909 - DNA, 409 bp, Homo sapiens
  misc_feature: GYAE6OF02I9H39.5.23.C01.1.454.CMB.1.raw
  modified_base (402)..(409): a, c, t, g, unknown or other
  misc_feature (402)..(409): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcgggctggcaaggcgcatagnnnnnnnn

SEQ ID NO: 144910 - DNA, 411 bp, Homo sapiens
  misc_feature: GYAE6OF02JXIB8.5.23.C01.1.454.CMB.1.raw
  modified_base (400)..(411): a, c, t, g, unknown or other
  misc_feature (400)..(411): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggccctgggctgcctggtcaaggactactcccgtgtctgatctgagcgggctggcaaggcgcatagnnnnnnnnnnnn

SEQ ID NO: 144911 - DNA, 417 bp, Homo sapiens
  misc_feature: GYAE6OF02JIAAA.5.23.C01.1.454.CMB.1.raw
  modified_base (290)..(290): a, c, t, g, unknown or other
  misc_feature (290)..(290): n is a, c, g, or t
  modified_base (402)..(402): a, c, t, g, unknown or other
  misc_feature (402)..(402): n is a, c, g, or t
  modified_base (404)..(417): a, c, t, g, unknown or other
  misc_feature (404)..(417): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtnttcccccctggcaccctcctccaagagcacctctgggggcacagcggccctgggctgcctggtcaaggactactcccgtgtctgatctgagcgggctggcaaggcgcatagngnnnnnnnnnnnnnn

SEQ ID NO: 144912 - DNA, 407 bp, Homo sapiens
  misc_feature: GYAE6OF02G2WIL.5.23.C01.1.454.CMB.1.raw
  modified_base (402)..(407): a, c, t, g, unknown or other
  misc_feature (402)..(407): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggccctgggctgcctggtcaaggactacttcccgtgtctgatctgagcgggctgggcaaggcgcatagnnnnnn

SEQ ID NO: 144913 - DNA, 404 bp, Homo sapiens
  misc_feature: GYAE6OF02G69RY.5.23.C01.1.454.CMB.1.raw
  modified_base (399)..(404): a, c, t, g, unknown or other
  misc_feature (399)..(404): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggcaccctcctccaagagcacctctggggcacagcggcctgggctgcctggtcaaggactacttccgtgtctgatctgagcggctggcaaggcgcatagnnnnnn

SEQ ID NO: 144914 - DNA, 415 bp, Homo sapiens
  misc_feature: GYAE6OF02IGAHP.5.23.C01.1.454.CMB.1.raw
  modified_base (402)..(415): a, c, t, g, unknown or other
  misc_feature (402)..(415): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggctactcccgtgtctgatctgagcgggctggcaagggcgcagtagnnnnnnnnnnnnnn

SEQ ID NO: 144915 - DNA, 407 bp, Homo sapiens
  misc_feature: GYAE6OF02IIPU8.5.23.C01.1.454.CMB.1.raw
  modified_base (403)..(407): a, c, t, g, unknown or other
  misc_feature (403)..(407): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaagggactacttcccgtgtctgatctgagcgggctggcaaggcgcatagnnnnn

SEQ ID NO: 144916 - DNA, 406 bp, Homo sapiens
  misc_feature: GYAE6OF02GQVFE.5.23.C01.1.454.CMB.1.raw
  modified_base (401)..(406): a, c, t, g, unknown or other
  misc_feature (401)..(406): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggcaccctcctccaagagcacctctgggggcacagcggccctgggctgcctggtcaaggactacttcccgtgtctgatctgagcggctggcaggcgcatagnnnnnn

SEQ ID NO: 144917 - DNA, 406 bp, Homo sapiens
  misc_feature: GYAE6OF02HTLV0.5.23.C01.1.454.CMB.1.raw
  modified_base (401)..(406): a, c, t, g, unknown or other
  misc_feature (401)..(406): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggcctgggctgcctggtcaaggactacttcccgtgtctgatctgagcgggctggcaaggcgcatagnnnnnn

SEQ ID NO: 144918 - DNA, 404 bp, Homo sapiens
  misc_feature: GYAE6OF02I3E4U.5.23.C01.1.454.CMB.1.raw
  modified_base (401)..(404): a, c, t, g, unknown or other
  misc_feature (401)..(404): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctggggcacagcggccctgggctgcctggtcaaggactacttcccgtgtctgatctgagcgggctggcaaggcgcatagnnnn

SEQ ID NO: 144919 - DNA, 524 bp, Homo sapiens
  misc_feature: GYAE6OF02JDB89.5.23.C01.1.454.CMB.1.raw
  modified_base (440)..(440): a, c, t, g, unknown or other
  misc_feature (440)..(440): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcataccgggagcaccaactacaatccgtccctcaagagtcgagtcacatatctatagacacgtcgaacaaccagttctcctgaacgtnacctctgtcgaccgccgcggacacggccgtctacttactgtgcgcggtatttcgagaggacaggactacgtatatcgacgtcgg

SEQ ID NO: 144920 - DNA, 405 bp, Homo sapiens
  misc_feature: GYAE6OF02HBKWE.5.23.C01.1.454.CMB.1.raw
  modified_base (402)..(405): a, c, t, g, unknown or other
  misc_feature (402)..(405): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcgggctggcaaggcgcatagnnnn

SEQ ID NO: 144921 - DNA, 404 bp, Homo sapiens
  misc_feature: GYAE6OF02IFHS0.5.23.C01.1.454.CMB.1.raw
  modified_base (401)..(404): a, c, t, g, unknown or other
  misc_feature (401)..(404): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctcaccaagggcccatcggtcttccccctggcaccctcctccaagagcacctctgggggcacagcggccctgggctgcctggtcaaggactacttcccgtgtctgatctgagcgggctggcaaggcgcatagnnnn

SEQ ID NO: 144922 - DNA, 548 bp, Homo sapiens
  misc_feature: GYAE6OF02HHJTJ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccacgcccccaggaaacgaggctgggagtggagttggggagatctatcagtaccgggagcaccaaactacaatccgtccctacaagagtcgagtcacatatctatacacacgtcgaacaaccagttcctccctgaacggtcgacctcgtgtcgacccgccgccggacgaccggccgtctacttactgtgccggcggtatttcgagtacgggacacggactactatacgtcgacgtacgg

SEQ ID NO: 144923 - DNA, 407 bp, Homo sapiens
  misc_feature: GYAE6OF02GJXL2.5.23.C01.1.454.CMB.1.raw
  modified_base (403)..(407): a, c, t, g, unknown or other
  misc_feature (403)..(407): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggcaccctcctccaagagcacctctgggggcacagcggccctgggctgcctggtcaaggactacttcccgtgtctgatctgagcgggctggcaaggcgcatagnnnnn

SEQ ID NO: 144924 - DNA, 539 bp, Homo sapiens
  misc_feature: GYAE6OF02HAA2C.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaagaggctgggagtggattgggggagatctatcagtaccgggagcaccaactacaactcccgtccctcaagagtcgagtcaccatatctatagacacgtacgaacaaccacgttctccctgaacggtgacctctcgtcgaccgccgcggaccaccggccgtctattactgtgcggtcggactttcgaggtaggacaggactactatactcgacgtcgg

SEQ ID NO: 144925 - DNA, 522 bp, Homo sapiens
  misc_feature: GYAE6OF02GT4ZQ.5.23.C01.1.454.CMB.1.raw
  modified_base (445)..(445): a, c, t, g, unknown or other
  misc_feature (445)..(445): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcatacgggagcaccaactacaatccgtccctcaagagtcgagtcacatactctatagacacgtcgaacaaccagttctcctgaaggtgacctnagtgaccgcgcggacacggccgtctattactgtgcgcggatttcgagagggacaggactactagtactcgacgtcgg

SEQ ID NO: 144926 - DNA, 531 bp, Homo sapiens
  misc_feature: GYAE6OF02GSMMP.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcataccgggagcaccaactacaatccgtccctcaagagtcgagtcaccatatctatagacacgtcgaacaaccagttactccctgaaggtgacctctagtcgaccgccgcggacacggccgtactacttactgtgcggcggatttcgagagggacacggactacgtatatcgacgtcgg

SEQ ID NO: 144927 - DNA, 563 bp, Homo sapiens
  misc_feature: GYAE6OF02I5KC6.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctggtccgccagcccccgaggaagaggctggagtggagttggggagagtctatcataccgggagcaccaactacaactcccgtccctacgaagagtcgacgtcaaccatactctatacgacacgtacgaacaaccacgttcctccctagtaacggtcgtacctctcggtcgacccggccgccgggacaccggcccgttactacttactgtcgacggccggtattccaggtagggacaggacgtactactagtccgtacgtcgg

SEQ ID NO: 144928 - DNA, 628 bp, Homo sapiens
  misc_feature: GYAE6OF02ISVQ1.5.23.C01.1.454.CMB.1.raw
  modified_base (362)..(362): a, c, t, g, unknown or other
  misc_feature (362)..(362): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtgacctgggtccgccagccccaggaagaggctggagtggagttcgggagatctatcgataccgggancaccaactacaatccgtccctcaagagtcgagtcaccatactctatacgacacgtacgaacaacctagttcctccctagaacggtcgaacccttcgtacgtcggacccgcccggaccgggaaccaaccgggtcccgttaccgttacttaaccgttcggttacggacccggtaccgggttaacgttttccgaacgggtaacgggggacctaacggggtaacccttaaaccgttaacgttacgttaccgggtacccggtttaccgggg

SEQ ID NO: 144929 - DNA, 523 bp, Homo sapiens
  misc_feature: GYAE6OF02FP6EJ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactataattggtggacctgggtccgccagcccccaggaaacgaggctggagtggattggggagatcgtatcataccgggagcacaactacaatccgtccctcaagagtcgagtcaccatatctatagacacgtcgaacaaccagttacctcctgaaggtgacctctgtgaccgccgcggacacggccgtctactactgtcgcgcggatttcagagggacaggactactatatcgagtcgg

SEQ ID NO: 144930 - DNA, 535 bp, Homo sapiens
  misc_feature: GYAE6OF02G76OE.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgttctcgtggctccatcagcactattaattggtggacctgggtccgccacgcccccaggaaagacggctggagtggagttggggagatctatcataccgggagcaccgaactacaatccgtccctcaacgagtcgagtcaccatatctatagacacgtcgaacaaccagttactccctagaacgtcgacctctgtcgaccgccgcggacacggccgtcgtatactgtcgcgcgtatttcgagacgggacaggtactactatactcgacgtcgg

SEQ ID NO: 144931 - DNA, 406 bp, Homo sapiens
  misc_feature: GYAE6OF02H3OFE.5.23.C01.1.454.CMB.1.raw
  modified_base (401)..(406): a, c, t, g, unknown or other
  misc_feature (401)..(406): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctccctccaagagcacctctggggcacagcggccctgggctgcctggtcaaggctacttcccgtgtctgatctgagcgggctggcaaggcgcatagnnnnnn

SEQ ID NO: 144932 - DNA, 528 bp, Homo sapiens
  misc_feature: GYAE6OF02FS3LO.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactataattggtggacctgggtccgccagccccccaggaaagaggctgggagtggattggggagagtctatcataccgggagcaccaactacaatccgtccctcaagagtcgagtcaccatatctatagacacgtcgaacaaccagttctccctgaacggtgacctctgtgaccgccgcggacacggccgtctattactgtcgcgcggactttcgagaggacgaggactactatatcgacgtcgg

SEQ ID NO: 144933 - DNA, 582 bp, Homo sapiens
  misc_feature: GYAE6OF02J17TB.5.23.C01.1.454.CMB.1.raw
  modified_base (280)..(280): a, c, t, g, unknown or other
  misc_feature (280)..(280): n is a, c, g, or t
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgttctcgtggctccatcngcactataatggtggacctggtccgccagcccccgaggaaacgnggctggagtcgggattggggganagtctagtcagtaccgggagccaacgaactacaactcccgtccctacgaacgtagtcgagtcaaccgatatctatacgaccaacgtcgaaacaacctagttcctacctagaacggtcgaaccttcgtagtcgacccgtccgccggaccacggaccgtctagttacctgtcgcggcggtacgtttacgacggtaacggacgtaggaacctacgttagtacttccgtacgttacggg

SEQ ID NO: 144934 - DNA, 536 bp, Homo sapiens
  misc_feature: GYAE6OF02JHQVP.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaagaggctggagtggagttggggagatctatcagtaccgggagacacaactacaatccgtaccctcaagacgtcgagtcacatatctatagacacgtcgaacaaccagttctccctgaacggtcacctctcgtacgaccgccgcgacgacggccgtctacttactgtcgcgtcggatttcgagacggacacggactacgtatacgtcgacgtcgg

SEQ ID NO: 144935 - DNA, 636 bp, Homo sapiens
  misc_feature: GYAE6OF02ICMJG.5.23.C01.1.454.CMB.1.raw
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
  modified_base (430)..(430): a, c, t, g, unknown or other
  misc_feature (430)..(430): n is a, c, g, or t
tcagatcagacacgcacgaccggtgctcgatttagtacacgtgattagggattgggcacgaccggtgctcgatttagtacacgtgattagggattggggataatttctgagactcatggacctcctgcacaagaacatgaaacacctgtggttcctcctcctcctggtggcagctcccagatgggccctgtctcaggtgcagctgcaggagtcggcccaggactggtgaagccgttcggggaccctgtccctcactgcgatgtttctcgtggctccatcagcactattaattggtggacctgggtccnccacgccccaggaaacgnggctggagtggagttggggagtatctatcgagtaccgggagcaaccaactaacaactcccgtaccctacgaacgtacgtcgagtaccaacctaatactcttaanacgaccacgtaccgaaaacctaacctaccgttctaccccgtagaacggtcgaccttcgtacggtacgtacccggacccgacggtaacccgaccgggtaccgttaccgttaattaccgcgttacggccggtacgggttaactttcggaacgggtacgggtaccaagggtacccttaagttaactacggtacccggtacgttaccggg

SEQ ID NO: 144936 - DNA, 526 bp, Homo sapiens
  misc_feature: GYAE6OF02G7G21.5.23.C01.1.454.CMB.1.raw
  modified_base (470)..(470): a, c, t, g, unknown or other
  misc_feature (470)..(470): n is a, c, g, or t
  modified_base (515)..(515): a, c, t, g, unknown or other
  misc_feature (515)..(515): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgttctcgtggctcatcagcactattaattggtggacctgggtccgccagcccccaggaaagaggctggagtggagttggggagatctatcagtaccgggagcaaccaactacaactccgtccctacaagagtcgagtcaccatatctatacgacacgtacgaacaaccagttcctccctgaaggtcacctctagtgaccgcgcgacncggcctctatactgtgcgcgtattcgagtcggacacggactatanactcgagtcgg

SEQ ID NO: 144937 - DNA, 408 bp, Homo sapiens
  misc_feature: GYAE6OF02FIHFR.5.23.C01.1.454.CMB.1.raw
  modified_base (273)..(273): a, c, t, g, unknown or other
  misc_feature (273)..(273): n is a, c, g, or t
  modified_base (402)..(408): a, c, t, g, unknown or other
  misc_feature (402)..(408): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccnccaagggcccatcggtcttccccctggcaccctcctccaagagcacctctgggggcacagcggccctgggctgcctggtcaaggactacttcccgtgtctgatctgagcgggctggcaaggcgcatagnnnnnnn

SEQ ID NO: 144938 - DNA, 593 bp, Homo sapiens
  misc_feature: GYAE6OF02H6P8Q.5.23.C01.1.454.CMB.1.raw
  modified_base (330)..(330): a, c, t, g, unknown or other
  misc_feature (330)..(330): n is a, c, g, or t
tcagatcagacacgcacgaccggtgctcgatttagtacacgtgattagggattgggcacgaccggtgctctatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgattgtttctcgtggctccatcagcactattaattggtggacctgggtccgccacgcccccgaggaaacgnggctggagtggagttggggagatcgtatcgacgtaccgggagcaccaactacaactccgtaccctacaagacgtacgacgtccacatatactatacgactacgtcgaaccaactagttcctaccctgaacggtcgacctctcggtacgacccgccggaccggaccgaccggcccgttactacttaccgtgtcggccggtcggtacttttcgaagggtacggacgtacggtacttaccgtaatacgtacggtaccgttaccggg

SEQ ID NO: 144939 - DNA, 547 bp, Homo sapiens
  misc_feature: GYAE6OF02HJ6FO.5.23.C01.1.454.CMB.1.raw
  modified_base (326)..(326): a, c, t, g, unknown or other
  misc_feature (326)..(326): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagnggctgggagtggagttggggagatctatcagtaccgggagcaaccaactacaaatcccgtaccctacaagagtcgagtcaccatactctatagacacgtacgaacaaccagttcctcctgaacggtcgacctctgtcgacccgccggccgacaccggccgtctacttacgtgtcgccgcggtacttcgacggaggacaggtacctatactatcgacgtcgg

SEQ ID NO: 144940 - DNA, 410 bp, Homo sapiens
  misc_feature: GYAE6OF02IF943.5.23.C01.1.454.CMB.1.raw
  modified_base (404)..(410): a, c, t, g, unknown or other
  misc_feature (404)..(410): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctccctccaagagcacctctgggggcacagcggccctgggctgcctggtcaaggactacttcccgtgtctgatctgagcgggctgggcaaggcgcatagnnnnnnn

SEQ ID NO: 144941 - DNA, 589 bp, Homo sapiens
  misc_feature: GYAE6OF02HZMX3.5.23.C01.1.454.CMB.1.raw
  modified_base (332)..(332): a, c, t, g, unknown or other
  misc_feature (332)..(332): n is a, c, g, or t
  modified_base (374)..(374): a, c, t, g, unknown or other
  misc_feature (374)..(374): n is a, c, g, or t
  modified_base (492)..(492): a, c, t, g, unknown or other
  misc_feature (492)..(492): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccagggactggtgaagccttcggggaccctgtccctcacctgcgatgtttctcgtggctccatcagctactattaattcggtggaccgtgggtccgccacgcccccaggaaacgnggctaggagtggagttggggagagtctatacgataccgggancgaaccaactaacgaactccgtccctagaacgtacgtcgacgtcacctatatctatagacacgtacaactaacagttctccgtagaggtcacgtctgacgacccggtccaccggaacnccgggtccgtacgttaactacgtggttacgcggtacggtacgtttacgacggacgggtactaacgggtactacgttaagtactacggtacgtacggg

SEQ ID NO: 144942 - DNA, 529 bp, Homo sapiens
  misc_feature: GYAE6OF02GM12D.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctgggagtggattggggagatctatcataccgggagcaccaactacaatccgtccctcaagagtcgagtcaccatatctatagacacgtcgaacaaccagttctccctgaacggtgacctctgtcgaccgccgcggacaccggccgtctattactgtcgcgcggtatttcagtacggacaggactactatatcgacgtcgg

SEQ ID NO: 144943 - DNA, 777 bp, Homo sapiens
  misc_feature: GYAE6OF02J0R21.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtcggcagctcccagatgggccctgtctcgaggtgcagctgcaggcgtcgggccaggactggtagaacgccgttcggggaccctgtccctcacctgcgatcgttctcgtcgctccatcagcactattaacgttggtcggtacctgggttcccgccgtaccggaccccctaagggaaacgtcgggaccgtcgggtaggtacgggtaggttggggaacgacgttacgtagtccaacggttaccccgggaagacccgaaaccgtaaaccgttaaccgaaacttaccccggttacccctaacgtaaacggtacgtaaccggtacgtaaccgtaacccaacttaaacgttccttaaacgtaacggtaacctaaccggtaccgaaaccgttaaaccccgtacgtttaccctaacccgttaccgaaacgggttaccgttaacccgttaccgttacggttacccggacccgggtcccggtaacccgggtacccgtaaacccgggtcccgttaaccgttacgtttaccgcgttcggaccggtcccgggttaagttttccggaacgggtacggaaccgtacggtacctaccgttaacgtacgtacccggtacgttaccggg

SEQ ID NO: 144944 - DNA, 517 bp, Homo sapiens
  misc_feature: GYAE6OF02FIVCO.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagagtctatcataccgggagcacaactacaatccgtcctcaagagtcgagtcacatatctatagacacgtcgaacaacagttctccctgagtgacctctgtgaccgcgcgacacgccgtctatactgtgcgcggatttccagtaggacaggactaactatactacgacgtccg

SEQ ID NO: 144945 - DNA, 577 bp, Homo sapiens
  misc_feature: GYAE6OF02IDIFL.5.23.C01.1.454.CMB.1.raw
  modified_base (329)..(329): a, c, t, g, unknown or other
  misc_feature (329)..(329): n is a, c, g, or t
  modified_base (416)..(416): a, c, t, g, unknown or other
  misc_feature (416)..(416): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagtccttcggggaccctgtccctcacctgcgatgtttctcgtggctccatcagcactattaattggtggacctgggtccgccacgcccccaggaaacgnggtctgggagtggagttggggagagtctatcagtaccggagcaccaactacaatcccgtcctacagacgtcgacgtccaccatactntatagacacgtacgaaacaacctacgttctaccctagaacggtcgtacctcgtgtcgaccggccgccggacaccgggtcctacgtacgttactgtcggcggtcggtactttcgaaggtacggacgtacggtactacttacgtacgtccggtagttaccggg

SEQ ID NO: 144946 - DNA, 872 bp, Homo sapiens
  misc_feature: GYAE6OF02JZPIZ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggcccctgtctacgtaggtcgacgacgtcgtcgacggaagggtcgggtcccgggacccgacggtacggtgggtaacggaaccggttcccgggttacccggggtacccgttcccgttccccgtaccgtaccgtcggaccgtagtttccggtttccgtcggtcggtccctcctacgtccgacgtacctaactttaacgtttaaggtttcgggtacggtaccggtccgggtaccccgccgaaccccggaccccggaaagggtaaacggcgggtacgtaaggggtaggtcggggtaagggttacggggaacgtacgttacgttacgtacgtaacgggtaccgggaacgaccgaaacctaacgtaacgtaacccgttcccgtacccgtaacgaacggtacgttacgtaacgtaccaaaccgttactacttaacgttaacgaaccgtaaccgtaaccggtaaccgaaaccgtaaccgttaccgttacccttaccggaacggttaaccggtacctaccgttccgttaggtacccgggacccgtacccgggaaccggtacccgaccgggttccgttaaccgtttaactaccggttaggtccggtacggtaccggtttaaccggttacggaacgggttaaacgggaccgttaaggtacccgtaaacgttacgttaccggtacggtaccggttacgggg

SEQ ID NO: 144947 - DNA, 566 bp, Homo sapiens
  misc_feature: GYAE6OF02GP3J2.5.23.C01.1.454.CMB.1.raw
  modified_base (326)..(326): a, c, t, g, unknown or other
  misc_feature (326)..(326): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagnggctgggagtgggattggggagatctatcagtaccgggagcaccaactacaatccgtccctcaagagtcgagtcaccatatctatagacacgtacgaacaaccagttacctccctgaaacggtcgaccttctacgtcgacccggccgaccggaccaccgggcccgttactacttaccgtgtcggcggcggtatttcaaggtacgggactagggacttacgtactacgtccggagttccgg

SEQ ID NO: 144948 - DNA, 549 bp, Homo sapiens
  misc_feature: GYAE6OF02GI2L2.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaatggtggacctgggtccgccagcccccaggaaacgaggctggaggtggattggggagatctatcataccgggagcaccaactaacaactccgtccctcaacgagtcgagtcaccatatctatacgacacgtacgaacaaccacgttctccctgaacggtcgacctctgtcgaccgccgcggacgacggccgtcgtacttacgtgtcgccggtcggtactttcgaggaggacgaggactaactagtactcgtacgtacgg

SEQ ID NO: 144949 - DNA, 539 bp, Homo sapiens
  misc_feature: GYAE6OF02GJZ9D.5.23.C01.1.454.CMB.1.raw
  modified_base (361)..(361): a, c, t, g, unknown or other
  misc_feature (361)..(361): n is a, c, g, or t
  modified_base (425)..(425): a, c, t, g, unknown or other
  misc_feature (425)..(425): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtcccctcacctgccgatgtttctcgtggctccatcagcactattaatggtgacctggtccgccagcccccaggaagaggctggagtggattggggagatctatcataccgggancaccaatacaatccgtaccctcaagagtcgagtcacatatctatagacacgcgaacacagttcnccctgaacgtgacctctagtcgaccgtccgacggacgaccgccgtctactactgcgacgtcggtatttcgaaggacgggtacacggtacttacgtagtacgtacgtacgtacgg

SEQ ID NO: 144950 - DNA, 403 bp, Homo sapiens
  misc_feature: GYAE6OF02HFVYH.5.23.C01.1.454.CMB.1.raw
  modified_base (394)..(394): a, c, t, g, unknown or other
  misc_feature (394)..(394): n is a, c, g, or t
  modified_base (399)..(403): a, c, t, g, unknown or other
  misc_feature (399)..(403): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggccaccctcctccaagagcacctctggggcacagcgcctggctgctggtcaaggactacttcccgtgtctgatctgagcgggctggcaaggcgnatagnnnnn

SEQ ID NO: 144951 - DNA, 597 bp, Homo sapiens
  misc_feature: GYAE6OF02F9KRB.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggaccgtgggtccgccacgcccccaggaaacgaggctggagtggagttggggagagtctatcagtaccgggagacaaccaactacaactcccgtaccctacaagagtacgacgtcaccatatctatacgactacgtacgaacaaccagttcctaccctagacgtacgtacctacgtcgtcgacccgccgtccggaaccgtaccggcccgttacgtacttaccgtgtcggtccggtacggttaacgtttcgacggagggtacgacggtacctaacgttaatacgtaccggtacgttaccggg

SEQ ID NO: 144952 - DNA, 527 bp, Homo sapiens
  misc_feature: GYAE6OF02INT7Q.5.23.C01.1.454.CMB.1.raw
  modified_base (408)..(408): a, c, t, g, unknown or other
  misc_feature (408)..(408): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaacgaggctggagtggattggggagatctatcataccgggagcaccaactacaatccgtccctcaagagtcgagtcacatatctanagacacgtcgaacaaccagttcctccctgaagtgacctctgtcgaccgccgcgacacggccgtctattactgtgcgcgtatttcgagtagggacaggacttacgtatagtcgacgtcgg

SEQ ID NO: 144953 - DNA, 530 bp, Homo sapiens
  misc_feature: GYAE6OF02GSRSP.5.23.C01.1.454.CMB.1.raw
  modified_base (253)..(253): a, c, t, g, unknown or other
  misc_feature (253)..(253): n is a, c, g, or t
  modified_base (449)..(449): a, c, t, g, unknown or other
  misc_feature (449)..(449): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctnacctgcgatgttctcgtggctccatcagcactattaattggtggacctgggtccgccagcccccaggaaacgaggcctggagtggattgggggagatctatcataccgggagcaccaactacaatccgtcctcaagagtcgagtcaccatatctatagacacgtcgaacaaccagttctccctgaacggtgacctntgtgaccgccgcggacacggccgtctattacctgtcgcggcggatttcgaagtaggacaggactacgtatatcgacgtcgg

SEQ ID NO: 144954 - DNA, 638 bp, Homo sapiens
  misc_feature: GYAE6OF02I9ITU.5.23.C01.1.454.CMB.1.raw
  modified_base (254)..(254): a, c, t, g, unknown or other
  misc_feature (254)..(254): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccttcggggaccctgtccctnacctgcgatgtttctcgtggctccatcagcactattaattggtcggtacctgggtccgccacgcccccgaggaagacggctggagtggagttggggagacgtcgtactcgaacgtaccggggacgtaccaacctaactaaccaacgtcccgtacccgtacgaacgtacggtaccgtaacgtaccaaccgtaactactactaactacgaaccgtacgtaccgaaacctaaccgacgtttcctaccccgttagaacgtacgacccttgtaccgttacgacccgtccggacggaccgtaccggtccgtacgtattaccgtgtcggcgtcggtatttacgacggtaggaccgacggtacttaacgtaacgtactacggtacgtccggg

SEQ ID NO: 144955 - DNA, 567 bp, Homo sapiens
  misc_feature: GYAE6OF02JVQXO.5.23.C01.1.454.CMB.1.raw
  modified_base (228)..(228): a, c, t, g, unknown or other
  misc_feature (228)..(228): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggngaagccttcggggaccctgtccctcacctgcgatgtttctcgtggctccatcagcactattaattggtggacctgggtccgccagcccccaggaaacgtaggctggagtggagttggggagatctatcataccgggagcaccgaactacaactccgtaccctcaagacgtcgagtcaccatatactatagacacgtacgaacaaccagttcctccctagtaacggtcgacctcgtcgtcgacccgccggaccggaccgaccgggcccgtacgttacttacctcgtgtccggcggtacttcgagtacgggacacggactacgtatacgtacgtacgtcgg

SEQ ID NO: 144956 - DNA, 408 bp, Homo sapiens
  misc_feature: GYAE6OF02FN3PY.5.23.C01.1.454.CMB.1.raw
  modified_base (402)..(408): a, c, t, g, unknown or other
  misc_feature (402)..(408): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggcaccctcctccaagagcacctctgggggcacagcggccctgggctgcctggtcaaggctacttcccgtgtctgatctgagcgggctggcaaggcgcatagnnnnnnn

SEQ ID NO: 144957 - DNA, 697 bp, Homo sapiens
  misc_feature: GYAE6OF02J13VH.5.23.C01.1.454.CMB.1.raw
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
tcagatcagacacgcacgaccggtgctcgatttagtacacgtgattagggagttgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgttctcgtggctccatcagcactataattggngacctggtccgcngccccaggaaacgnggctggacgtggattggggacgaagtcgttaagtcgacgttaaccggggagtaccgaaccaacgtacgaaacgtcccgtaccctacgaacgtagtaccggtaagtaccaacccgtagtaactcgttaaactacggaactacggtaccgtaaaccaacccgtaacgttaccctacccgttacggtaaacgggttacgtaaccctcgttacggtacggtaaccccggccggtaccgggtaacccgaaccgggtacccgtcgtttaaccgtttacccgtgttaaccggccggtacggttaaccgtttcgaacggtaaggggaacccttaggggtaacctaacccgtttaataacggttccggaaaccgtttcccgggg

SEQ ID NO: 144958 - DNA, 540 bp, Homo sapiens
  misc_feature: GYAE6OF02HRU4E.5.23.C01.1.454.CMB.1.raw
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctggtccctcacctgcgatgtttctcgtggctccatcagcactattaattggtggaccttgggtccgccagcccccagggaaagaggctgggagtggagttggggagtatctatcagtaccgggagcaccaactacaactcccgtccctcaacgagtcgacgtcacatactactatagacacgtcgaacaaccntctccngacgtcgactctgtgaccgccgngaccacggcctcgtatacgtgtcgcggcggtactttcgaggacggagacggtactactatactcggacgtcgg

SEQ ID NO: 144959 - DNA, 527 bp, Homo sapiens
  misc_feature: GYAE6OF02HTS69.5.23.C01.1.454.CMB.1.raw
  modified_base (472)..(472): a, c, t, g, unknown or other
  misc_feature (472)..(472): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggagttggggagatctatcataccgggagcaaccaactaacaactccgtccctcaacgagtcgatcaccatatctatagacacgtacaaaccaacacgttctccctagaacggtcgactctgtcgaccgccgcgacncggcgtctatactgtgcgcggtattcgagaggacaggactactatatcgagtcgg

SEQ ID NO: 144960 - DNA, 526 bp, Homo sapiens
  misc_feature: GYAE6OF02G13VC.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaacgaggctggacgtggattggggagatctatcataccgggagcaccaactacaatccgtaccctcaagagtcgagtcaccatatctatagacacgtcgaacaacagttctccctgaacgtgacctctgtcgaccgccgcgacacggccgtctatactgtgcgcggtatttcgagtaggacaggactactatactcgacgtcgg

SEQ ID NO: 144961 - DNA, 715 bp, Homo sapiens
  misc_feature: GYAE6OF02J08HD.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcgaggtgcagctgcaggagtcgggcccaggactggtgaagccgttcggggaccctgtccctcacctgcgtatgtttcctcgtcggcttccgagttccacggtctaccgttaattaagttgggtacggtacccgttacgggtcccgtccgaacggtccccccgaagggaaacgggacgggtccgtagggtacggtagggtacggttcgggggaagtacgtcgtaacgtcgtacgtaaccgggagaccgaaccgaaacgtaccaaacgtcccgtacctacgaacgacgtcgtaacgtccaactagtactctacgtacgacctacgtaccgaacctaaccgtacggttccctaccgtacgtaaaggtccgtaaacttccgtacgttacgacccgtaccggtacggaaccgacccggtcccggttactaacctttaccgtacggttcgaccggtcggttaacttccgaacgggtaggaaccgtacggacttaacccgtagtacggttaccgtaccggttaccggg

SEQ ID NO: 144962 - DNA, 408 bp, Homo sapiens
  misc_feature: GYAE6OF02GCFV6.5.23.C01.1.454.CMB.1.raw
  modified_base (404)..(408): a, c, t, g, unknown or other
  misc_feature (404)..(408): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctgggggcagagggaccacggtcatcgtctcctcagcctccaccaagggcccatcggtcttcccccctggcaccctcctccaagagcacctctgggggcacagcggccctgggctgcctggtcaaggactacttcccgtgtctgatctgagcgggctggcaaggcgcatagnnnnn

SEQ ID NO: 144963 - DNA, 413 bp, Homo sapiens
  misc_feature: GYAE6OF02IIW4F.5.23.C01.1.454.CMB.1.raw
  modified_base (403)..(413): a, c, t, g, unknown or other
  misc_feature (403)..(413): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcgtcttccccctggccaccctcctccaagacgccacctcgtggggcacagcggccctggctgctggtcaaggactacttcccgtgtctgatctgagcgggctgggcaaggcgcatagnnnnnnnnnnn

SEQ ID NO: 144964 - DNA, 545 bp, Homo sapiens
  misc_feature: GYAE6OF02F1Q4U.5.23.C01.1.454.CMB.1.raw
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactggtgaacgccttcggggaccctgtcccctcacctgcgatgttctcgtggctccatcagcactattaattggtggacctgggtccgccacgcccccaggaaacgaggctggagtggagttggggagatactatcagtaccgggagacaaccaactacaactcccgtaccctcaagacgtacgagtcacatatctatacgacacgtcaacaaccagttcctaccctagacgtcgacctctgtcgaccgccgcggaccncggccgtctacttctgngcgcggtattcgagacggacaggtactacgtatacgtcgacgtcgg

SEQ ID NO: 144965 - DNA, 546 bp, Homo sapiens
  misc_feature: GYAE6OF02HUP3O.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaacgaggcgtggagtggagttggggagagtctatcgataccgggagcaaccaactaacaactcccgtccctacaagacgtcgacgtacaccatatctatacgacacgtcaaacaacctagttacctccctagagtcgacctcgtagtcgaccgccgcggacacggcctctactactgtgcgcggtacttcgaggaggacaggactactatagtcgtacgtacgg

SEQ ID NO: 144966 - DNA, 552 bp, Homo sapiens
  misc_feature: GYAE6OF02HECEF.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggtacctgggtccgccagccccccaggaaagagggctgggagtggagttggggagatctatcataccgggagcaccaactacaatccgtcctacaagagtcgagtcaaccataactctaatacgacacgtcgaacaaccagttcctccctagaacggtcgacctctgtcgaccgccggcgaccgaccggccgtctacttactgtcgcggcggtatttcgagtacgggacaggactaacgtatactcgacgtcggg

SEQ ID NO: 144967 - DNA, 409 bp, Homo sapiens
  misc_feature: GYAE6OF02IXCLM.5.23.C01.1.454.CMB.1.raw
  modified_base (404)..(409): a, c, t, g, unknown or other
  misc_feature (404)..(409): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggcaccctcctccaagagcacctctgggggcacagcggccctgggctgcctggtcaaggactacttcccgtgtctgatctgagcgggctgggcaaggcgcatagnnnnnn

SEQ ID NO: 144968 - DNA, 581 bp, Homo sapiens
  misc_feature: GYAE6OF02G8FFU.5.23.C01.1.454.CMB.1.raw
  modified_base (473)..(473): a, c, t, g, unknown or other
  misc_feature (473)..(473): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctcgtccctcacctcgcgatgtttctcgtggctccgatcagcactattaattggtggacctgggtcccgccagccccccaggaaacgagggcgtacggaggtggagttgggggagagtcgtaagtcagtaccggggagccgaaccaaacgtacaactcccgtccctaccaaggacgtcgacgtcaaccatactctatacgacacgtacaacaaccgattcctccgtanaacggtcgacctctacgtcgaccgtcgaccgacaccggctaccgtattacgtgcggtcgcggtactttcgaggtagggacacggtactactagtagtccgagtccggg

SEQ ID NO: 144969 - DNA, 765 bp, Homo sapiens
  misc_feature: GYAE6OF02HBZ50.5.23.C01.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (336)..(336): a, c, t, g, unknown or other
  misc_feature (336)..(336): n is a, c, g, or t
tcagatcagacacgcacgaccggtgctcgatttagtacacgtgattagggattggcacgaccggtgctcgatttagtacacgtgattagggattgggatactttctgagactcatggacctcctgcacaagacatgaaacacctgtggttcctcctcctcctggtcggcagcctcccagatcgggccctgtctcgaggtncagctgcaggngtcgggccaggcnggtagaacgtccgttcggggaccctgtcccgtacaccgtgccgattcggttctacggtcggtcctccactcgacgccgaactactttaatcgggtgacccgttggggtcccnccgaccgcccccgaaggaaaggacggcgtaggaggtaggtaagttgggggactaactccgtaagtcgtaacgtacggggacacgaccgtaaacctaacaaacgtccggttacccacaaggacgtacgacggtaccacctaacgtaatactaacgtaacgactaaaccgtaaccgtaaactaaacccgaaacggtttcctaccccgttaagaaaccggtacgtaacccgtactacgggttaaccaacccgggacccgaccgggtaaaccgtaccgggtaacccgtaccgtttaacggttaaccgttccgggttaccggtacccgggtaaccggttacgttttaaccggaacgggtaaaccggggtaacgaaaccgggtttaaacccgttaacgtaaacccggtttacctaaccggtaccggttaaccggg

SEQ ID NO: 144970 - DNA, 546 bp, Homo sapiens
  misc_feature: GYAE6OF02FT8UW.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtcccctcacctgcgatgtttctcgtggctccatcagcactattaattggtggacctgggtccgccagcccccaggaagaggctgggagtggattggggagatctatcataccgggagcaccaactacaatccgtaccctcaagacgtcgagtcaccatatctatagacaccgtcgaacaaccagttctccctagaggtcgacctctgtcgacccgccgcggacaccggccgtctacttactgtcgcggtcggtatttcgagtacgggacgacggacttacgtatacgtccgagtccgg

SEQ ID NO: 144971 - DNA, 574 bp, Homo sapiens
  misc_feature: GYAE6OF02INA2N.5.23.C01.1.454.CMB.1.raw
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtcccctcacctgcgtatgtttctcgtggctccatcagcactattaattggtggacctgggtccnccgacgcccccaggaagaggcgtggagtggagttggggagatctatcagtaccgggancaccaactacaactcccgtaccctcgaacgagtacgacgtaccacctatactactatacgaactaccgtacaaaccaacctagttcctccctagacggtcactcttagacgaccgccggtcgaccgaccggtccgtactacttacgtgtcgacggcgtacttacgaggtacggacacggactactagtacgtacgacgtacggg

SEQ ID NO: 144972 - DNA, 464 bp, Homo sapiens
  misc_feature: GYAE6OF02HGHBJ.5.23.C01.1.454.CMB.1.raw
  modified_base (200)..(200): a, c, t, g, unknown or other
  misc_feature (200)..(200): n is a, c, g, or t
  modified_base (393)..(393): a, c, t, g, unknown or other
  misc_feature (393)..(393): n is a, c, g, or t
  modified_base (428)..(428): a, c, t, g, unknown or other
  misc_feature (428)..(428): n is a, c, g, or t
  modified_base (436)..(437): a, c, t, g, unknown or other
  misc_feature (436)..(437): n is a, c, g, or t
  modified_base (441)..(464): a, c, t, g, unknown or other
  misc_feature (441)..(464): n is a, c, g, or t
tcagatcagacacgcacgaccggtgctcgatttagtacacgtgattagggattggggagagtctatcataccgggagcaccaactacaaatccgtccctcaacgagtcgagtcaccatatctatagacacgtcgaacaaccagttctccctgaaggtgacctctgtgaccgccgcggacaccggccgtctatactgtgcncggatttcagagggacaggactactatactcgaacgtctaggggcagagggacccacgggtcaagtcgtctccgtcaggcctccacaagggcccatcggtccttcccctggccacctccgtccaacgacgcacctctggggcacgagccggcctgggcctcgcctcggtcaagggactacgttccgtgtctancttgacgcgggctcggacaacggcgtacagtacgngagctagnngacnnnnnnnnnnnnnnnnnnnnnnnn

SEQ ID NO: 144973 - DNA, 647 bp, Homo sapiens
  misc_feature: GYAE6OF02H9V0Z.5.23.C01.1.454.CMB.1.raw
  modified_base (368)..(368): a, c, t, g, unknown or other
  misc_feature (368)..(368): n is a, c, g, or t
tcagatcagacacgcacgaccggtgctcgatttagtacacgtgattagggattgggcacgaccggtgctcgatttagtacacgtgattagggattgggatactttctgagactcatggacctcctgcacaagaacatgaaacacctgtggttcctcctcctcctggtggcagctcccagatgggccctgtctcaggtgcagctgcaggagtcgggcccaggactggtcgaagccttcggggacccctgtccctcacctgcgatgtttctcgtggctccgatcagcactataacttgtggacctgggtccgccagcccccaggaacgaggactggagtggacttggggagatctaatcgataccggganacgaccgaaactaccaaagtcccggttaccctacgaacgagttaccgacgtcaaccgataattccgtaatacgaaccgtaaccgtacgaaactaacccgtacgtttacctaccccgtgaaacggtcgaccgttcgtacgttacgaacccggccgacccgggtactaaccgggtccggttacctagtttaacccgtgtacgtccggtccgggtaatttaccggaggtaacgggaactcgggaaaccttacgttacgtagttacccgtaacggttaccggg

SEQ ID NO: 144974 - DNA, 582 bp, Homo sapiens
  misc_feature: GYAE6OF02IVEZ3.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggacctgggtcccgccacgccccccaaggaaacgacggctggagtggagttggggagatcatcagtaccgggagcaccaactacaactccgtccctcgaagagtacgagtcaccatactctatagaaccacgtacgaaccaactacgttcctaccctgaacggtgacccctgtcgtcgacccgccggacggaccaccggccgtactacttacgtgtcgcggtcggtacgtttccgaggacgggtacgacggtacctaacgttagtacgtaccggtacttaccggg

SEQ ID NO: 144975 - DNA, 584 bp, Homo sapiens
  misc_feature: GYAE6OF02IR675.5.23.C01.1.454.CMB.1.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
  modified_base (350)..(350): a, c, t, g, unknown or other
  misc_feature (350)..(350): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtncagctgcaggagtcgggcccaggactggtgaacgccgttcggggacccctgtccctcacctgcgatgtttctcgtggctcatcagcactattaattggnggtacctgggtccgccacgcccccaggaagaggctggagtggagttgggagntctatcatacgggagcaaccaactacaatccgacctcaagagtcgagtcaccatatctatacgactacgtcaaactaaccagttacctacctagtaacggtcgtacctcgttacgacgacccgtccgacgggaccgaaccggccgttactacttaccgtcgtcgccggacggtactttcgaacggtacgggaacgtacggtaacttacgtaacttacgtccgtaccggttcggg

SEQ ID NO: 144976 - DNA, 907 bp, Homo sapiens
  misc_feature: GYAE6OF02IFR6W.5.23.C01.1.454.CMB.1.raw
  modified_base (182)..(182): a, c, t, g, unknown or other
  misc_feature (182)..(182): n is a, c, g, or t
tcagatcagacacgcacgaccggtgctcgatttagtacacgtgattagggagttgggcgacgacccggtgctcgatttagtacacgtgattagggattggggagtactttctgagactcatggacctcctgcacaagaacatgaaacacctgtggttcctcctcctcctggtgcagctcccngactcgggcctgtctcaggtgcagctgcaggagtcggccaggactggtgaaggccgttccggggaccctcggtccctccgtacctgccgatcgtttcgtcgtggtcctccgactcacgctacgttattaacgttggttacggaccgttcggggtcccgcccgaccgtaccccccgaagggaaaacggacgggtacgtcggggtaacgtcggggtaaggttacggggtacgtacgttcgtacgtacgtaacggtacccggggtaacgaccgaaacccgtaaacgtaaccgtaaccgtaccccggtaccccgtaaccggtaacgtaccggtttaccggtaacgtttacccggaaacccttaaacgttaaacccgttaccttaaaccggttaaacggtaaacccgtaacccgggttaaacccggtaaaacccgtaaacccggttaaaccgttttccccgtaaccccgttaacgggtaaaccgggttacccggtaaccgttacccgttcgggttaacccggtaaccccgggacccggtaacccggggtaacccgtaaccccgggttacccggttaacccctttaacgtttaaccgtccgggttaaacgggtcccgggtaaacccggttaacgtttttacccgggaagggtaacccggggtaaaccttaccggggaaacccgtttaaccggttaaacgtaaccggtttccggaacccgggtttaccgggg

SEQ ID NO: 144977 - DNA, 494 bp, Homo sapiens
  misc_feature: GYAE6OF02IUFZR.5.23.C01.1.454.CMB.1.raw
  modified_base (459)..(459): a, c, t, g, unknown or other
  misc_feature (459)..(459): n is a, c, g, or t
  modified_base (461)..(494): a, c, t, g, unknown or other
  misc_feature (461)..(494): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacgggtcatcgtctcctcagcctccaccaagggcccatcggtcttcccccctggccacccctcctccaacgacgccaccctccgtcgggggccacgacgccggccccgtcggggcctgcccgtggtaccaagggaccttaccgttcccggtacgttcctgacttcgtacgacggccggggcttgggaccgaaggggccgacgagtaggcgngnnnnnnnnnnnnnnnnnnnnnnnnnnnnnnnnnn

SEQ ID NO: 144978 - DNA, 558 bp, Homo sapiens
  misc_feature: GYAE6OF02G295M.5.23.C01.1.454.CMB.1.raw
  modified_base (370)..(370): a, c, t, g, unknown or other
  misc_feature (370)..(370): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccttcggggaccctgtccctcacctgcgatgtttctcgtggctccatcagcactattaattggtggacctgggtccgccagcccccgaggaaacgaggctggacgtggagttggggagatcgtatcgataccgggancaaccaactacaactccgtaccctacaacgagtacgacgtcaccgatactctatagaccacgtacgaaacaaccagtttccaccctagaacggtcgacctcgtcgcgaccgccgcgacgaccggccgtctacttctgtcgcggcggatttcgagacgggacacggacttacgtatagtccgagtcggg

SEQ ID NO: 144979 - DNA, 799 bp, Homo sapiens
  misc_feature: GYAE6OF02JZ961.5.23.C01.1.454.CMB.1.raw
  modified_base (199)..(199): a, c, t, g, unknown or other
  misc_feature (199)..(199): n is a, c, g, or t
  modified_base (759)..(759): a, c, t, g, unknown or other
  misc_feature (759)..(759): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtncagctgcaggacgtcgggccaggactggtgaacgcccgttacggggacccttggtccctcacccgttgcggtagttcgtttcgtcggtggtcctccaatcaacggtcctacgttaattaagttcgggtcggtacccgtttgggtcccgcccgtaaccggaccccccggaagggaaaacggacgggtccggttagggaacgggttgggtaaggtttaggggacgtatcgttacgtacgtaacggtaccggggacgtaccaaccgtaaacgttaaccgaacgttccccggttacctaaccgaacgtacgggttaccgaacggttaccaacccgtaacttaacttaccgttaaacgttacggaacccggttaccggtaaacccggtaaacctaaacccggttaccggtttaccgtacccccgttaagggtaaccgggttaccggttaacccttcggtaccggttacccggaccgggtacccggtacggacccgacccgggttacgtacttaaccgttacgtacggtcggacggtccggttagttaccgaacgggttaaccggngaacggttacctaacgttcaacggttccgaacgttccggg

SEQ ID NO: 144980 - DNA, 544 bp, Homo sapiens
  misc_feature: GYAE6OF02GQZNZ.5.23.C01.1.454.CMB.1.raw
  modified_base (477)..(477): a, c, t, g, unknown or other
  misc_feature (477)..(477): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggacctgggtccgccagcccccaggaaacgaggctggacgtggattggggagatcgtatcataccgggagcaccgaactacaactccgtaccctcaagagtcgagtcaacatatctatacgacacgtcgaacaaccagttctaccctgaacggtcgacctctcgtcgaccgccgcggacnccggcctactacttactgtgcgtcggtactttcgaggacggacaggtactactatatcgtacgtcgg

SEQ ID NO: 144981 - DNA, 418 bp, Homo sapiens
  misc_feature: GYAE6OF02IQ4F9.5.23.C01.1.454.CMB.1.raw
  modified_base (406)..(418): a, c, t, g, unknown or other
  misc_feature (406)..(418): n is a, c, g, or t
tcagatcagacacgcacgaccggtgctcgatttagtacacgtgattagggattggggagatactatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtcgtggggcagagggaccacggtcatcgtctcctcagcctccaccaagggcccatcggtcttcccccctggccaccctcctccaagagcacctctggggcacagccggccctgggctgcctggtcaaggatacttcccgtgtctgatctgagcgggctgggcaaggcgcatagnnnnnnnnnnnnn

SEQ ID NO: 144982 - DNA, 415 bp, Homo sapiens
  misc_feature: GYAE6OF02GY2S7.5.23.C01.1.454.CMB.1.raw
  modified_base (406)..(415): a, c, t, g, unknown or other
  misc_feature (406)..(415): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagacgcacctctgggggcacagccggccctgggctcgcctggtcaaggactacttcccgtgtctgatctgagcgggctggcaaggcgacatagnnnnnnnnnn

SEQ ID NO: 144983 - DNA, 720 bp, Homo sapiens
  misc_feature: GYAE6OF02I8CSO.5.23.C01.1.454.CMB.1.raw
  modified_base (333)..(333): a, c, t, g, unknown or other
  misc_feature (333)..(333): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggacccctgtccctcacctgcgatgtttctcgtggctccatcagcactattaagttggtcggtacctgggtccgccacgccccgaaggaacgnggctgggagtggagttggggatacgtactatcgacgttaccggggagaccaaccgaaactacaacgttcccgtaccctacgaacgacgtccgacgtaccaacctaatacgttacttaacgtaacgaaccgtaccgtaaccgaaacctaaccgtaacgtttccctacccgtaggtaaacgggtacctaacccgttcgttacggtaccgaccccggacccggaccggtaacccgaacccgggtccccggttaacttaccgtttacctcgggttacggacccgggtaccgggttaacgttttaccggaaacgggtaacggggtaacccgtaacgggtaacccgttaaacgttaaccgttaacgttacccgggtaacggtttaccccgggg

SEQ ID NO: 144984 - DNA, 601 bp, Homo sapiens
  misc_feature: GYAE6OF02I7H89.5.23.C01.1.454.CMB.1.raw
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttcncgtgctccgatcagcactattaattggtgacctcgggtccnccgagcccccgaggaaacgaggcctggagtcggagttggggagatctatcacgtaaccgggagaccgtaccaaacgtaccaaattcccggtaccccttcgaaacgacgtacgaacgtacacccatactactacagaccaacgtacgaaacctaaaccgacgtttactaccctacgtaacggtgacccgttctacgttcgaccgccggtcggaccgaccggccgtactagttacctgtcgacggcggtatttacgaggtaggacgaggactacgtatacgtcgtagtaccggg

SEQ ID NO: 144985 - DNA, 471 bp, Homo sapiens
  misc_feature: GYAE6OF02ITD1W.5.23.C01.1.454.CMB.1.raw
  modified_base (430)..(430): a, c, t, g, unknown or other
  misc_feature (430)..(430): n is a, c, g, or t
  modified_base (433)..(435): a, c, t, g, unknown or other
  misc_feature (433)..(435): n is a, c, g, or t
  modified_base (437)..(471): a, c, t, g, unknown or other
  misc_feature (437)..(471): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcaggagggaccaggtcatcgtctcctcagcctcaccaagggcccatcggtcttcccccctggccaccctcctccaacgacgcaccctctcgggggccacgacgcggcccgtgggcttgccctggtccaagggactacgttcccgtgtctgactctcgagcgggctgggtacaagggtcggcgtagtagctgncgnnngnnnnnnnnnnnnnnnnnnnnnnnnnnnnnnnnnnn

SEQ ID NO: 144986 - DNA, 423 bp, Homo sapiens
  misc_feature: GYAE6OF02I0NSH.5.23.C01.1.454.CMB.1.raw
  modified_base (313)..(313): a, c, t, g, unknown or other
  misc_feature (313)..(313): n is a, c, g, or t
  modified_base (411)..(423): a, c, t, g, unknown or other
  misc_feature (411)..(423): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtctccccctggcaccctctccaagngcacctctgggggcacagccggccctgggctcgccgtggtacaagggaccttaccgttccgtcgtctgactctgacgcgggctggcaaggcgcatagnnnnnnnnnnnnn

SEQ ID NO: 144987 - DNA, 595 bp, Homo sapiens
  misc_feature: GYAE6OF02JHURD.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtcccctcacctgcgatgtttctcgtggctccatcagcactattaattggtggacctgggtccgccagcccccaggaacgaggcgtggagtggattggggagatctatcagtaccgggagacaccaactacaactccgtccctcaagacgtcgacgtccacatatctatacgacacgtcaacaacagttcctccgtagaacgtcgacctcgtacgtacgacccgccgaccggaccgtacggcccccgttagtactttacgtcggttcggccggtaccgggtacttttacgaacggtacgggaacgacgggtaccttaacgtaacgttacgtaccggtacgttacccggg

SEQ ID NO: 144988 - DNA, 610 bp, Homo sapiens
  misc_feature: GYAE6OF02INGF0.5.23.C01.1.454.CMB.1.raw
  modified_base (372)..(372): a, c, t, g, unknown or other
  misc_feature (372)..(372): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcgggaccctgtccctcacctgcgatgtttctcgtggctccatcagcactattaagttggtggaccgtcgggtccgccacgccccgaggaacgaggctggagtggagttggggagactacgtatcgagtaccgggancgaaccaactaacaactcccgtaccctacaacgtacgtacgacgtaccacctaatactactaatacgacctaacgtaccgaaacctaacctacgttacctacccgtagtaacggtcgaccgtcgtagtacgacccgccggacggaccgtaccgggtccgtacttacgttacgtcgtacggcggtacggtacttcgaaggtacggaacgtacggacttacgtatacgtcgtacgtacgg

SEQ ID NO: 144989 - DNA, 673 bp, Homo sapiens
  misc_feature: GYAE6OF02IIRMC.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggccaggactggtgaagccttcggggaccctgtccctcacctgcgatgttctcgtggctccatcagcactattaattggtggacctgggtccgccacgcccccaggaaagaggctgggagtcgggagttggggagagtctaatcaagtaccgggagaccaccaactacaactcccgtccctacaacgacgtacgacgtcaccaatatctatacgacaacgttaccgaacaacccgtaagttcctaccccgtagtaaacggtcgtaccgttacctaggtaccgacccgggtacccgaccgggaaacccgtaccggggccccgttaccgttaacgtttacccgttacgggttcggtacccgggtccgggttaacgttttacccgaacgggtaaccggggtacccgtacgggtaacccgttaacctaacggttaacttaccgggtaacccgttacccggggg

SEQ ID NO: 144990 - DNA, 562 bp, Homo sapiens
  misc_feature: GYAE6OF02GR6U3.5.23.C01.1.454.CMB.1.raw
  modified_base (367)..(367): a, c, t, g, unknown or other
  misc_feature (367)..(367): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggacctgggtccgccagcccccaggaacgaggctggagtggagttggggagtatctatcagtaccgggancaccaactacaatcccgtaccctacaagacgtcgagtcaccatactctatacgacacgtacgaacaaccagttcctcctagaaggtcgacctcgtgtcgaccgccggcggaccaccgggccgtacttacgttacctgtcgcggtcggtactttcgaggtacgggacgtaggacctactatacgtcgacgtacggg

SEQ ID NO: 144991 - DNA, 409 bp, Homo sapiens
  misc_feature: GYAE6OF02H2TKQ.5.23.C01.1.454.CMB.1.raw
  modified_base (403)..(409): a, c, t, g, unknown or other
  misc_feature (403)..(409): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggcaccctcctccaagagcacctctgggggcacagcggccctgggctgcctggtcaaggactacttcccgtgtctgatctgagcgggctggcaaggcgcatagnnnnnnn

SEQ ID NO: 144992 - DNA, 534 bp, Homo sapiens
  misc_feature: GYAE6OF02I6OKJ.5.23.C01.1.454.CMB.1.raw
  modified_base (328)..(328): a, c, t, g, unknown or other
  misc_feature (328)..(328): n is a, c, g, or t
  modified_base (479)..(479): a, c, t, g, unknown or other
  misc_feature (479)..(479): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggacccctgtccctcacctgcgatgtttctcgtggctccatcagcactattaattggtggacctgggtccgccacgcccccaggaaagnggctgggagtgggattggggagatctatcataccgggagcaccaactacaactccgtccctcaacgacgtcgagtcaccatactctatagacacgtcgaaaccaaccacgttcctccctagacggtcgacctctgtcgaccgccgcgaccncggcctctactactgtgcgcgtattcgagaggacaggactatatatcgacgtcgg

SEQ ID NO: 144993 - DNA, 567 bp, Homo sapiens
  misc_feature: GYAE6OF02IRTLG.5.23.C01.1.454.CMB.1.raw
tcagatcagacacgcacgaccggtgctcgatttagtacacgtgattagggattgggcacgaccggtgcctcgatttagtacacgtgattagggattggggatactttctgagactcatggacctcctgcacaagaacatgaaacacctgtggttcctcctcctcctggtggcagctcccagatgggccctgtctcacggtgcagctgcaggagtcgggcccaggactggtgaagccttcggggaccctgtccctcacctgcgatgtttctcgtggctccatcagcactacttaattggtaggaccgtgggtccgccacgcccccaggaacgaggctggagtggagttggggagatctatcagtaccgggagcacaactacaactccgtccctacacgagtcgatcaccgatactctatacgacacgtcaacactacttactccctagaacggtcacctcgtgtacgaccgtccgaccggacaccggtccgtacttacttacgtcgtggaccggtccggtactttacgagagggtaccaggtactacgtatactaccgtacgttacgg

SEQ ID NO: 144994 - DNA, 557 bp, Homo sapiens
  misc_feature: GYAE6OF02IS6UD.5.23.C01.1.454.CMB.1.raw
  modified_base (268)..(268): a, c, t, g, unknown or other
  misc_feature (268)..(268): n is a, c, g, or t
  modified_base (325)..(325): a, c, t, g, unknown or other
  misc_feature (325)..(325): n is a, c, g, or t
  modified_base (362)..(362): a, c, t, g, unknown or other
  misc_feature (362)..(362): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttcncgtggctccatcagcactattaattggtggacctgggtccgccagcccccaggaagnggctggagtggattggggagatctatcataccgggancgaaccaactacaatccgtaccctcaagagtcgacgtacacatatactatagacacgtacgaacaaccagttcctacctgaacggtgacctctgtacgaccgtccgcggaccacggccgtactacgttactcggtgtaccggcggtactttcgaacgagggacaaggacttactatactacgtacggttacgggg

SEQ ID NO: 144995 - DNA, 533 bp, Homo sapiens
  misc_feature: GYAE6OF02FJHD8.5.23.C01.1.454.CMB.1.raw
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
  modified_base (489)..(489): a, c, t, g, unknown or other
  misc_feature (489)..(489): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgtccagccccccagggaaacgaggctgggagtggattgggggagatctatcagttaccgggagcaccaactacaatccgtccctcaagagtcgagtcaccatatctatagacacgtcgaacaaccagttacnccctgaacgtgacctcngtgaccgccgcggacacggcctctactactgngcgcggatttcgagagggacaggactacgtatactcgacgtcgg

SEQ ID NO: 144996 - DNA, 614 bp, Homo sapiens
  misc_feature: GYAE6OF02IZMWV.5.23.C01.1.454.CMB.1.raw
  modified_base (550)..(550): a, c, t, g, unknown or other
  misc_feature (550)..(550): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtcccgcctacgcccccgaggaaacgacggctgggtaggtggagttggggagtagtctatacgagtacccgggtagaccaaccaaactaacaaactcccgtacccctacgaacgagtccgagtaccaacctataactctaatacgtaaccgacgtaccgaaacaacctagttaccctaccctagaacgtacaccttcgtacgtacgacccgccgaccggaccgaccgggtccgttcctaagttccngttcggcgtcggtcttcgaacgtacggaacgacggacctacgtagtacgtacgtaccgtaccgg

SEQ ID NO: 144997 - DNA, 978 bp, Homo sapiens
  misc_feature: GYAE6OF02INX7H.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtgggccctgtctcgaggtgcgagctgcaggagtcgggcccaggaccgtggtgaacggccgttccggggaccctcggtccctcaccgtcgcgtacttcgtttcctcggtcggtccgtcccattcgacgacctacttaagtttaacgttgggtacgggtaacccgttcggggtcccgtacccgaccgtaccccccgaagggtaaaacggacggtcgtacgggtacggtacggggtaaggttacgggggaacgtaacggttaccgtaccgttaacggtaacggttaacccgggggaacgtacccggaaacccgtaaaccgtaaacctaaaccggttaccccggttaccccgtaccggtaaacgggtaccgttaaccggtaccggttaacccgtaaacccgtaaccttaaacgttaccgttaaacgtaaacccggtaaccgtaaaccggttaaaccgtaaaaccccgtaaacccgtttaaccgtttaccccgtttacccccggtaagggtaaaccgggttaacccggttaaccgttacccgttaaccgggttcccggtaaacccccgggttacccggaaccccgggttaacccggggaaaccccggggtttaaccccgttcccggtttaaactttaaccccgggttacgggttacccgggttacccgggtaacccgggtttaaccgttttacccggggtaaaccggtaaacccggggggtaaccggtaaaccgggttaacccggttaaacccgttaaccggtttaaccggttacccggtaaccggggtttaccccggggg

SEQ ID NO: 144998 - DNA, 652 bp, Homo sapiens
  misc_feature: GYAE6OF02JRF82.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactggtgaacgccgttcggggaccctgtccctcaccgtgcgattcgtttctcgtggcctccatcagctactattaattgggtggtaccgtcgggtccgtcccgaccggtcccccgaagggaaacgacgggcgtagggaggtaggtacggttggggagactcgtactacgtacggtaccgggacgacgaaccgaaactaacgaacttcccgtaccctacgaacgacgtaccgacgtaccactatactactacgtaacgaccaacgtacgaaccaaccgtacgttacctacccgtagtaacggtacgtacctcgtcgtacggacccgccggacgaccgaccggtaccgtacgttacgttacgtcggtcgccgtacggtacttacgaacggacggtacgacgtacgtacgtagtacgtaccgtacggtacgg

SEQ ID NO: 144999 - DNA, 558 bp, Homo sapiens
  misc_feature: GYAE6OF02HFF7I.5.23.C01.1.454.CMB.1.raw
  modified_base (500)..(500): a, c, t, g, unknown or other
  misc_feature (500)..(500): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattggtggacctgggtccgccacgcccccaggaaacgaggctgggacgtggacgttggggagatcgtatcagtaccgggagcaccaactacaaactcccgtaccctacgaagacgtcgagtaccaaccgatactctaatacgaccacgtacgaaacaacctacgttcctccctagaacggtcgaccttcgtgtcgacccgccgcggacnccggcctctatactgtgcgcggtacttcgagaggacaggactactatatcgacgtcgg

SEQ ID NO: 145000 - DNA, 675 bp, Homo sapiens
  misc_feature: GYAE6OF02J1H3F.5.23.C01.1.454.CMB.1.raw
  modified_base (330)..(330): a, c, t, g, unknown or other
  misc_feature (330)..(330): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (410)..(410): a, c, t, g, unknown or other
  misc_feature (410)..(410): n is a, c, g, or t
  modified_base (492)..(492): a, c, t, g, unknown or other
  misc_feature (492)..(492): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctggtccctcacctgcgatgttctcgtggctccatcagcactattaagttggtgacctggtccgccgacgcccccgaggaaacgnggctggagtggagttgggganagtcgtancgacgtaccgggagaccgaaccaaactaaccgaacgttcccgtacccgtanaacgacggtccgaataccgaaccctagtacttactacgtaacgtaacaccggttaccgaaacctaaacccgacggtttaccnccccgttaaggtaacggtcgtaaccttccgtagttaccggaaccggtcccgacgggaacctacgggacccgttacgttaacctttacggtcgtacggtccgggcggtttaaccgtttacgaacgggttacgggaaccaacgggttacctaaccgttagtaccggtaccgtaacggttaccggg

SEQ ID NO: 145001 - DNA, 407 bp, Homo sapiens
  misc_feature: GYAE6OF02IC5S0.5.23.C01.1.454.CMB.1.raw
  modified_base (372)..(372): a, c, t, g, unknown or other
  misc_feature (372)..(372): n is a, c, g, or t
  modified_base (396)..(407): a, c, t, g, unknown or other
  misc_feature (396)..(407): n is a, c, g, or t
tcagatcagacacgcacgaccggtgctcgatttagtacacgtgattagggattgggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggcaggactactatatcgacgtctggggcagagggaccacggtcatcgtctcctcagcctccaccaagggcccatcggtcttccccctggccaccctcctccaagacgcacctctggggcacagcgcctgggctgcctggtcagacacttccgtgtctgatctnagcgggctgggcaaggcgcatagnnnnnnnnnnnn

SEQ ID NO: 145002 - DNA, 527 bp, Homo sapiens
  misc_feature: GYAE6OF02JAM5K.5.23.C01.1.454.CMB.1.raw
  modified_base (307)..(307): a, c, t, g, unknown or other
  misc_feature (307)..(307): n is a, c, g, or t
  modified_base (449)..(449): a, c, t, g, unknown or other
  misc_feature (449)..(449): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgttctcgtggctcatcagcactattaattggtggacctgggtccnccacgccccaggaagaggctggagtggagttggggagtatctatcagtacgggagcaccaactacaactccgtcctcaagagtcgagtcacatactctatacgacacgtacaacaactagttcctcctgaaggtcactcgtntcgaccgccgcgaccacggcctntacttcgngtcgcgtcgtattcgagtacggacagtactactatactcgacgtcgg

SEQ ID NO: 145003 - DNA, 726 bp, Homo sapiens
  misc_feature: GYAE6OF02GJ97W.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcggcccaggactggtgaacgccgttcgggaccctgtccctcacctgcgatgtttctcgtggcctccatcagctactattaagttggtcggtaccgtcggggtcccgaccgaccggtaccccccgaagggaaacggacgggtaccgtagggtaacggtaggggtaacgtttaggggggaagtacgttaccgtaagtaccgtaacggtaacccggggagaccaaaccgaaacgttaaccgaaaccttccccgttaccccgtacgaaacggtacgtaccggtaacgtaccaaccaacgttaactaccttaaagtaacgaacctaccggttaaccgaaaacctaaacccgtacggttttaccctacccgttacggtaaacggttcgtaacccttcgtacggtcgacccggccggtacggaccgaccggtcccgtactacgttacgtgtcgacggtcggtatttcggaaggtacgggacaacgggtaccttaacgtagttacgtacgtacggtaccggg

SEQ ID NO: 145004 - DNA, 915 bp, Homo sapiens
  misc_feature: GYAE6OF02J3ERC.5.23.C01.1.454.CMB.1.raw
  modified_base (146)..(146): a, c, t, g, unknown or other
  misc_feature (146)..(146): n is a, c, g, or t
  modified_base (423)..(423): a, c, t, g, unknown or other
  misc_feature (423)..(423): n is a, c, g, or t
tcagatcagacacgcacgaccggtgctcgatttagtacacgtgattagggattgggcacgaccggtgctcgatttagtacacgtgattagggattggggatactttctgagtactcatggacctcctgcacaagaaccatgaaacncctgtcggttcctcctcctctggtgcagcctccaggtcgtcgggtccctggtcctacgaggtcggacacgtccgtgccgacgggacgtccggggacccagggtacgttcgggtacgtaaccggtcccggttaccggggtaccccttcggtaccccttaaccgtaccgttggccgttacgttccgtttcccgtcggtccggtaccctaacccgtacgtacccgaacggtacctaaccgtttagttaacgggtttcggtacggtaccgtcgggtacccnccggtaaccggaccccgtaagggaaaacgtcgggtacgtacgggtacgggtacggtaacgggtacggggtactaaccgttcgtaaccggttaccgaaacccggttaaccggggtaacgaaccctaaacccgttaaacccgttaaacccgttaaacccggttccccgtaaaccccgtttaacgaacgttaaccggggttaacgaccgtaaccgtaacctaacgtaacctacgttaacgacgtaaccggtacggtaaaccgtaaacccttaaccgtaccgttacccggttaccgtaacgggttaccgtacggttacccgttaggtacccggtacccgggtaacccgtcccggggaaacggtttaccccgaacggttccccgtaaagtttaccgtaccggttacgggtccggtaacgggtccgtttaacgaccggtacgggtaacggtactaaccggtactaaacgtcccggtaacgtccggtaacggtcccggg

SEQ ID NO: 145005 - DNA, 537 bp, Homo sapiens
  misc_feature: GYAE6OF02G3ZP6.5.23.C01.1.454.CMB.1.raw
  modified_base (485)..(485): a, c, t, g, unknown or other
  misc_feature (485)..(485): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtcccctcacctgcgatgtttctcgtggctccatcagcactattaattggtggacctgggtccgccagcccccaggaaagaggctggagtggattggggagatctatcataccgggagcaccaactacaatccgtccctcaagagtcgagtcacatatctaatagacacgtcaacaaccagttcctcctagaacgtcgaccctctgtcgacccgccgcggaccacggcctctattaccngtcgcgtcggtatttcgagagggacaggtactacgtatacgtcgagttcggg

SEQ ID NO: 145006 - DNA, 613 bp, Homo sapiens
  misc_feature: GYAE6OF02HXY1Y.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggccaggactggtgaagccttcggggaccctgtccctcacctgcgatgtttctcgtggctccatcagcactattaattggtggaccgtgggtccgccgacgaccccccgaggaaacgacggcgtggacgtggaggttggggagatcgtatcgagtaccgggagtacaaccaactaacaactcccgtccctacaacgtacgtacgacgtaccaaccatactactaatacgaaccgacgtacgaaacctaaaccgtacgttacctacccgtagaacggtcgtaaccgtcgtcgtacgacccggccggaccggacgaccgggtccgtacgttacttacgtgtcgtcggtacggtacttcgaggacggacgaggtactaactatacgtaccgtacgtaccggg

SEQ ID NO: 145007 - DNA, 592 bp, Homo sapiens
  misc_feature: GYAE6OF02ISD1D.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcgggggaccctgtccctcacctgcgatcgtttctcgtggctccatcagcactattaattggtggaccgtgggtccgccgacgacccccgaggaacgaggcgtggagtggagttggggagatctatcgacgtaccgggagcaaccaactacaatcccgtccctacaacgacgtacgacgtacacatactactatacgacaccgtacgaaaccaacctacgttcctaccgtagtaacggtcgacctcgtacgtcgaccgccggcggaccgaccgggccgttactacgtttcgtggtcgtcggcggttacttcgaggacgggacgtacggacttactagtactccggtacgtaccggg

SEQ ID NO: 145008 - DNA, 719 bp, Homo sapiens
  misc_feature: GYAE6OF02INLRH.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccgagatcgggccctgtctcaggtgcagctgcagggcgtccggccgagtacgtggtagacgtccggttccgggacctccggtcctccaccgtgcgtacgttcgtttcgtcgtcggtcctccatcacgctacttaagttaagttgggtacggtacgtcgggtcccgaccgtaccgaccccgaagggaaacgcggtacggtaggtagggtaggtacggttaggggaagtacgtacgtacgtacgtaaccggtaccgggacgtaacccaaaccgtaaacctaactaaccgtaccccgttacccgtaagacggtaccgtacgtacgtaaccaacgtaataccttactaagtaacgaaccgtacgtaacgaaacctaactaccgtttaccgaccgttaggaacggtcctaccgttcgtacgacccgacccggtaccgaccggtaacgcccggtacttaaccttagttaccgtcgtacggtaccggtccggttattaccggaaggaccggtaacgacgtaccttagtacgtacgtaccggcgttacggg

SEQ ID NO: 145009 - DNA, 538 bp, Homo sapiens
  misc_feature: GYAE6OF02HZK3J.5.23.C01.1.454.CMB.1.raw
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
  modified_base (524)..(524): a, c, t, g, unknown or other
  misc_feature (524)..(524): n is a, c, g, or t
tcagatcagacacgcacgaccggtgctcgatttagtacacgtgattagggattgggcacgaccggtgctcgatttagtacacgtgattagggattggggatacttttctgagactcatggacctcctgcacaagaacatgaaacacctgtggttcctcctcctcctggtggcagctcccagatgggccctgtctcaggtgcagctgcaggagtcgggccaggactggtgaagccttcggggaccctgtccctcacctgcgatgtttctcgtggctccatcagcactattaattggtgacctgggtccgccagcccccaggaaagnggctggagtggagttgggganatctatcataccgggancaccaactacaatcccgtcctcaagagtcgacgtcaccatactctatacgacacgtacgaacaaccagttcctcctagaaggtcacctctgtcgaccgccggcgacacggccgtctatactgtgccggcggtattcgaggtacggacaggactacgtaatntaccgacgttcggg

SEQ ID NO: 145010 - DNA, 627 bp, Homo sapiens
  misc_feature: GYAE6OF02I3BZQ.5.23.C01.1.454.CMB.1.raw
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaatggtggacctgggtccnccacgccccaggaagcggctggagtggagttgggganagtctatcagtaccggganacaaccaaactacacgtccgtaccctacgaagtagtcgtagtaccaacgtatactactataacgacaccgtaccgaaacaacctacgttacctacccgtagaacggtccgtaccgttcgtgtaccggacccgtccggccggtaaccgacccgggtcctaccgtttaacgttacgtcggtcggtcggtaccggtctttaccggaaggtaccggggaacgtacgggacgttaacgtaacgtacgttacggtacccggttacggg

SEQ ID NO: 145011 - DNA, 615 bp, Homo sapiens
  misc_feature: GYAE6OF02JCEN1.5.23.C01.1.454.CMB.1.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccttcggggaccctgtccctcacctgcgatgttctcgtggctccatcagcactattaagttggtcggtacctcgggtccgccacgccccgaggaacgnggcgtggagtggngttggggatatcgtatcacgtaccgggagacaaccaactaccgactcccgtaccctcgaacgtacgtacgacgtaccactactactctaatacgaaccaacggtaccgaaacctaactacgttacctacccgtagtaacggtcaccgtctacggtcgacccgaccggccggaaccgtccgggacccttagtaccttacgtcgtaggccggtgtacgttacgacggtaggaacctacgggaaccttacgtactacggtaccgtacggtcggg

SEQ ID NO: 145012 - DNA, 581 bp, Homo sapiens
  misc_feature: GYAE6OF02HOT7R.5.23.C01.1.454.CMB.1.raw
  modified_base (374)..(374): a, c, t, g, unknown or other
  misc_feature (374)..(374): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttccctcctcctcctggtggcagctcccagatgggccctgtctcaggtgcagctgcaggagtcgggcccaggactggtgaacggccttcggggaccctcgtccctcacctgcgattgtttctcgtggctccatcagcactattaattggtggacctgggtccgccacgcccccaggaagacggctagggagtggagttggggagatctatcaagtaccgggancaaccaactaacaactccgtaccctacaagacgtacgacgtacaacctatactctatagacacgtacaaacaacctattacctccagtaacgtcgtacctcgtacgtacgaccgccggccgacgaccgggccgtacttacgttacgtgtcggcggtacggtattcgaaggtacgggacacggtactacgtatacgtccgtacgtcgg

SEQ ID NO: 145013 - DNA, 611 bp, Homo sapiens
  misc_feature: GYAE6OF02HFWY4.5.23.C01.1.454.CMB.1.raw
  modified_base (253)..(253): a, c, t, g, unknown or other
  misc_feature (253)..(253): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcgaggagtcgggcccaggctggtcgaagccgttcgggaccctgtcccncacctgcgatgtttctcgtggctcatcagcactattaatggtggaccgtggtccgccgacgaccccgaaggaacgcggctggagtggagttgggagatctatcagtacgggagcacaactacaactccgtacctacaagacgtcgacgtaccactaactatactaatacgaacctaacgaccgaaacaaaccgtacgttacctccgttagaacggttcgaaccttctacggtcgacccggtccgacggaaccgaccggtaccgttacgtacgttacgtacggttcgccggtaacggtctttacggacggtacgggacgtacggtaacttacgtaacgtacgttcggacggttaccggg

SEQ ID NO: 145014 - DNA, 702 bp, Homo sapiens
  misc_feature: GYAE6OF02IXQGT.5.23.C01.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtactcaggtncagtctgcaggagtccgggccaggactggtacgaacgcccgttacggggaccctggtccctcaccgtgcgtattgtttctcggtgcctcactcagctactattagtggtcggtaccgtcgggtccgccgacgacccccgaaggaaacgacgggtcgtagggagtacggtagttaggggagtaacttacgtagtacgaacgttaaccggggacgtactaaaccgtaacgttaacaacttacccggtacctacgtaaacggtcgtacggaacgtccaaccgtactaacgtctaagtacgtaacgaccgtaccgaaactaaccgtagtttaccctaccgtagtaacggtacaccgttcctacggtaccgaccgtaccggaccggaaccgtaccggtacgttccgtaagttaccgtgtacggtaccggtacggttaccgtttacgacgggtacgggtaacgtacggtaaccgttacgtaacgtacggttaccgtggttaacccggg

SEQ ID NO: 145015 - DNA, 628 bp, Homo sapiens
  misc_feature: GYAE6OF02F476S.5.23.C01.1.454.CMB.1.raw
  modified_base (270)..(270): a, c, t, g, unknown or other
  misc_feature (270)..(270): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtcccctcacctgcgatgtttcncgtggctccatcagcactattaatggtgacctgggtccgcacgccccaggaaacgaggctggagtggagttggggaagatactatcgagtaccgggagacaaccaaataaccaagtcccgtacccctcgaaagacgtacgacgtaccaaccgatatactataacgaactacgaccgaaaccaaccgagtttaccctacccgtacgtaacggtcgaacctcgtacgtacgacccgccggaccggaccgaaccgggtccgtaccgtacgtttacgtcgtcggccggtacggtaactttaccgaaggtaacgggacgtaacgggtaccttaacggtactaacgttccggaaccgttccggg

SEQ ID NO: 145016 - DNA, 625 bp, Homo sapiens
  misc_feature: GYAE6OF02IY2SO.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgtttctcgtggctccatcagcactattaattgggtggtaccgtggtccgcccagcccccgaggaaacgaggctgggagtggattggggagattcgtatcataccggggagtcaaccaactacaaactccgtaccctcaacgagtacgacgtacaccatacgtctaatacgacaccgtaccgaaccgaaccagtttccgtaccctagaacggtcgacctcgttacgtcgtaacccgccgacgggaccgaccggtcccggtaccttaacgttaccgtgtacggtcggaccggtacgttttcgaacgggtagggaaccgtaagggtaaccttaaccgtaattacggttaccggaacggttccggg

SEQ ID NO: 145017 - DNA, 583 bp, Homo sapiens
  misc_feature: GYAE6OF02IA6VR.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtctctcacctgcgatgtttctcgtggctccatcagcactataattggtggactcgggtccgccacgccccccgaggaaacgaggccgtggagtggagttgggggagagtctatcgagtaccgggagacaaccaaactacaacgtcccgtaccctacaagtacgtcggagtccaaccatactactataacgactacgtaccgaaaccaaccgacgttcctccctagaacggtcgaccttactgtcgaccgccgaccggaccgacggccgttactacttacgtggtcggcggtcggtacttccgagacggacagggtacctagtatacgtcgtacgg

SEQ ID NO: 145018 - DNA, 583 bp, Homo sapiens
  misc_feature: GYAE6OF02ITCXZ.5.23.C01.1.454.CMB.1.raw
  modified_base (486)..(486): a, c, t, g, unknown or other
  misc_feature (486)..(486): n is a, c, g, or t
  modified_base (520)..(520): a, c, t, g, unknown or other
  misc_feature (520)..(520): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttccggggaccctgtccctcacctgccgatgtttctcgtggtctccatcagcacttattaattggtggtaccgttcggggtccgccgacggccccccgaagggaaacgaggcgtgggagtgggagttggggagagtctatcagtaccggagcaacaactacaactccgtacctcaagtacgtacgagtccaacatatactatacgacaccgtacgaaccaactacgttccgtcctagtacggtgaccctntacgtcgacccgcggacgaccgcggcccgtactnttacgtgtcgcggccgtacttggagtacgggacacggtacttactagtacgttcgacgtcggg

SEQ ID NO: 145019 - DNA, 644 bp, Homo sapiens
  misc_feature: GYAE6OF02I3M5C.5.23.C01.1.454.CMB.1.raw
  modified_base (271)..(271): a, c, t, g, unknown or other
  misc_feature (271)..(271): n is a, c, g, or t
  modified_base (384)..(384): a, c, t, g, unknown or other
  misc_feature (384)..(384): n is a, c, g, or t
tcagatcagacacgcacgaccggtgctcgatttagtacacgtgattagggattgggcacgaccggtgctcgatttagtacacgtgattagggattgggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggacccctgtccctcacctgcgatgtttcncgtggctccatcagctactattaattggtcggtacctgggtccgccaccgcccccgaaggaaagacggcgtaggaggtggacgttggggagatcgtagtacgacgtacggganaccaaccgaactacaactcccgtccctacgaagtacgtcgtacgtccaaccgattactactaactagacctacgtacaaacctaaccgtacgttacctcccgtagtacggtctaaccgttcgtacggtacgacccgccggtacgaccgtaccggtcccgtacttacttaccgtagtcggccggtaccgggttatttacggaacgggtacgggtaacggaacggttaccgtaacttagtaacgttaccggtacggtccggg

SEQ ID NO: 145020 - DNA, 559 bp, Homo sapiens
  misc_feature: GYAE6OF02G1FY5.5.23.C01.1.454.CMB.1.raw
  modified_base (452)..(452): a, c, t, g, unknown or other
  misc_feature (452)..(452): n is a, c, g, or t
  modified_base (486)..(486): a, c, t, g, unknown or other
  misc_feature (486)..(486): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtcccctcacctgcgatgtttctcgtggctccatcagcactattaattggtggaccttgggtcccgccgacgcccccaggaaagagggcctgggagtggagttggggagatcgtagtcagtaccgggagaccaaccaacgtacaactcccgtccctacaagtacgtcgaagtcaacatatctatagacacgtcgaacacagttcncctgacgtgactacgtgtcgaccgccgcggaccncggccgtctagttccgtgtcgcggtcggtatttcggagtacggacacggtactaacgtatactcgacgttcgg

SEQ ID NO: 145021 - DNA, 626 bp, Homo sapiens
  misc_feature: GYAE6OF02IRVNF.5.23.C01.1.454.CMB.1.raw
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactgggtgaacgcccgttcggggaccctgtcccctcacctgcgatgtttctcgtcggctcgatcagcactattattggtggaccgtgggtccgccacgccccgaaggaacgnggctaggagtggagttcgggganatctatacgacgtaccggganaccaacaaactacaacttcccgtaccctgaaacgagtacgacgtacaaccatatactaatacgactaacgtacgaaacctaactacgttacctccgtagaacggtcacccttgtacgtaccggacccgtccggccgggaacctaccgggtcccgttaacgttacgttacgtgtcggccgtacggttaattcggaacggaacgggacctaacggaccttacgtaactacgtaccggtaggttacccggg

SEQ ID NO: 145022 - DNA, 417 bp, Homo sapiens
  misc_feature: GYAE6OF02IU5N1.5.23.C01.1.454.CMB.1.raw
  modified_base (405)..(417): a, c, t, g, unknown or other
  misc_feature (405)..(417): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacgggtcatcgtctcctcagcctccaccaagggccatcggtcttcccccctggcaccctcctccaagacgcacctctgggggcacagcggccctgggctggcctggtcaaggactaccttcccgtgtctgatctgacgcgggctggcaggcgcatgnnnnnnnnnnnnn

SEQ ID NO: 145023 - DNA, 528 bp, Homo sapiens
  misc_feature: GYAE6OF02IR4C7.5.23.C01.1.454.CMB.1.raw
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagcccgttcggggaccctgtccctcacctgcgatgtttctcgtggctccatcngcactattaattggtgacctgggtccnccncgcccccaggaaacgnggctggngtggagttggggagatctatcagtaccgggagcaccaaactacaactccgtccctacaacgacgtcgagtacaccatatctanagacacgcaacaacattcctcctgagtcnctctgngaccgcgcgaccacggctactattactgtcgcgcggtatttcgagagggacaggactagtatactcgacgtcgg

SEQ ID NO: 145024 - DNA, 723 bp, Homo sapiens
  misc_feature: GYAE6OF02IVXNU.5.23.C01.1.454.CMB.1.raw
  modified_base (282)..(282): a, c, t, g, unknown or other
  misc_feature (282)..(282): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagcctcccagatcgggccctgtctcgaggtgcagctgcgaggacgtccgggcccaggactggtgaacgtcccgttcggggaccctcgtccctcacctgcgagttcgtttcncgtggtcctccgtactcgagctaacttagtttaagttgggtacggaacgttcgggcccgtacccgaccggtacccccgaaggaaacggtcggacgtacgggaaggttgggacggttggggtaatacgtacgtaacgtaccgaaggtaaccgggaacgaccgaaaccaaacgtaactaacctcccgtaccctacgaacggtacgtaccggtactacaaccgtatagttacctagacgtaacgaaccgtactaaaccgtaacctacgtttaccctaccgtacggtaacggtaccgtaccttacggttccgtaccggtacccgaccgggtacggaaccgtaccgggtcctaacgtacgttaccgtcgtacggaccgtacggttaaccgttggaacgggtacggtaacgacggtactaacgtacgtacgtacgtacggttccggg

SEQ ID NO: 145025 - DNA, 414 bp, Homo sapiens
  misc_feature: GYAE6OF02HD9Y4.5.23.C01.1.454.CMB.1.raw
  modified_base (404)..(414): a, c, t, g, unknown or other
  misc_feature (404)..(414): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcgtcttccccctggcaccctcctccaagagcacctctgggggcacagcggccctgggctgcctggtcaaggactacttcccgtgtctgtatctgagcgggctgggcacgggcgcatagnnnnnnnnnnn

SEQ ID NO: 145026 - DNA, 641 bp, Homo sapiens
  misc_feature: GYAE6OF02HLC87.5.23.C01.1.454.CMB.1.raw
  modified_base (485)..(485): a, c, t, g, unknown or other
  misc_feature (485)..(485): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcagggagtcgggcccaggactggtgaagccgttcggggaccctgtccctcacctgcgatgttctcgtggctccatcagcactattattggtggacctgggtccgtccgacgccccccagggaaacgacggccgtaggtaggtcggtaagttggggagtaacgtctagtctaggtaccgggagtaccgaaccaactaacgaaacttcccgtaccctacgtaacgacgtacgacgtcaacctatacgtactagtacgtaacctacgtaccgaacgtaaaccncgttactacccgtagaacggttcgactcgtacgtcgaccgccggtacggaccgtaccggtaccgtacttacgttaccgtgggttctccgggtacgtagtttaccgaggaacggtacgacggtaactaccgttacgtacgtacggtaccgttacggg

SEQ ID NO: 145027 - DNA, 408 bp, Homo sapiens
  misc_feature: GYAE6OF02G9EQF.5.23.C01.1.454.CMB.1.raw
  modified_base (404)..(408): a, c, t, g, unknown or other
  misc_feature (404)..(408): n is a, c, g, or t
tcagatcagacacgcacgaccggtgctcgatttagtacacgtgattagggattgggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgatctgagcgggctgggcaaggcgcatagnnnnn

SEQ ID NO: 145028 - DNA, 602 bp, Homo sapiens
  misc_feature: GYAE6OF02HPORR.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcatgtttctcgtggctccatcagcactattaattggtggtacctgggtccgccgtacgccccccgaagggaaacgacggctgggagtggagttggggagagtctagtcagtaccgggagccaccaaactacaatcccgtaccctacgaacgtacgtcgagtcaccatatctatacgacacgtacgaaccaaccgtagttcctaccctggaacggtcgtaaccctcgttacgtcgacccgcccggacgaacccgtaccgggaccgtaccgttacttaccgtgtcggtcggacggtatttccggaaggtacgggactacggactaccgtatacgtcgacgttccgg

SEQ ID NO: 145029 - DNA, 586 bp, Homo sapiens
  misc_feature: GYAE6OF02HSPE7.5.23.C01.1.454.CMB.1.raw
  modified_base (376)..(376): a, c, t, g, unknown or other
  misc_feature (376)..(376): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggccaggactggtgaagccgttcggggaccctgtccctcacctgcgatgtttctcgtggctccatcagcactattaattggtcggaccgtgggtccgccacgcccccagggaaacgaggctgggagtggagttggggagagttctagtcaacgtaccggganaccaaccaactacaactcccgtccctacgaagacgtacgacgtcacctatactctatacgaacacgtacgaaaccaaccagttcctccgtagaagtcgactcgtgtcgacccgtccggacggacgaccggccgtactacttacgtgtcgcggcggtacttcgaggtacgggacgtaggtaacctactacgtacgtacggacgttaccggg

SEQ ID NO: 145030 - DNA, 450 bp, Homo sapiens
  misc_feature: GYAE6OF02HBXT6.5.23.C01.1.454.CMB.1.raw
  modified_base (429)..(450): a, c, t, g, unknown or other
  misc_feature (429)..(450): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtcgtggggcagagggaccacggtcatcgtctcctcagcctccaccaaggcccatcggtccttccccctggccaccctccctccaagacgccacctcgtgggggcacaggcccggcccgtgggcgtcgccgtggtcaacggtactacttcccgtcgtctgctctggacgcgggctcgggcgaacgggccgcgagtagcnnnnnnnnnnnnnnnnnnnnnn

SEQ ID NO: 145031 - DNA, 534 bp, Homo sapiens
  misc_feature: GYAE6OF02GNOL8.5.23.C01.1.454.CMB.1.raw
  modified_base (229)..(229): a, c, t, g, unknown or other
  misc_feature (229)..(229): n is a, c, g, or t
  modified_base (492)..(492): a, c, t, g, unknown or other
  misc_feature (492)..(492): n is a, c, g, or t
  modified_base (528)..(528): a, c, t, g, unknown or other
  misc_feature (528)..(528): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggctcaggactggtnaagccttcggggaccctgtccctcacctgcgatgtttctcgtggctccatcagcactattaattggtggacctgggtccgccagcccccaggaaacgaggcctgggagtggagttgggggagatctatcagtaccgggagcaccaactacaatcccgtaccctcaagacgtcgacgtcaccatactctatacgacacgtacgaaaccaaccacgttcctcccgtagaaggtcgacctctgcgaccgccgtcggacacggtccnctatctgtgccgcgattcagagggcaggactacatncgtacg

SEQ ID NO: 145032 - DNA, 740 bp, Homo sapiens
  misc_feature: GYAE6OF02JT1BV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaacacctgtcggttcctcctcctcctggtcggcagcctcccagacgtcgggccctgtcctcgacggtgccagctgcaggacgtccgggccaggacgtggtgacgtccgtcggggaccctcgtccctcaccgtcgacgtagttcgttccgtcggtcgtcctccagtccacgcgtacttagttaacggttcgggtacggtacccgttcggggtcccctaccgacccggaccccgaagggaaacggacggtcggtgggtaacgtggggtacggtacgggggaatacgtccgttaactcgtaaccggtaccgggtacgaccgtaacccgaaactaacccgacgttaccccgtacccgtaacggaacgtacggtaccgtacgtaaccctacgaaacttactacctaagtaaccgaccgtacggtaaccgaaactaaccggtacttctacccgtaggtaccgcgtaacctcgtacggacccgcccggtaccgacggtacccgaccggtactaccgttacgtactggtaccggccgtaccggttacttacgggaggtaacccggtacgaacgttacctaccgttaagtaccgttccggacggttcgg

SEQ ID NO: 145033 - DNA, 550 bp, Homo sapiens
  misc_feature: GYAE6OF02FZFSJ.5.23.C01.1.454.CMB.1.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (444)..(444): a, c, t, g, unknown or other
  misc_feature (444)..(444): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgccgatgtttctcgtggctccatcagcactattaattggtggacctgggtccgccagcccccaggaagnggctggacgtggattgggganatctatcgataccgggagcgaaccaaactacaactccgtaccctcaagagtcgagtcaccatagtctatacgacacgtcgaacaacagttctccctnaaggtcaaccgtctgtcgaccgccgtacggacaccggccgtctacttactgtcgcgtcggactttcgacgaggacgacggtactactagtacgtcgtacgtaccgg

SEQ ID NO: 145034 - DNA, 426 bp, Homo sapiens
  misc_feature: GYAE6OF02JJ4LP.5.23.C01.1.454.CMB.1.raw
  modified_base (318)..(318): a, c, t, g, unknown or other
  misc_feature (318)..(318): n is a, c, g, or t
  modified_base (412)..(426): a, c, t, g, unknown or other
  misc_feature (412)..(426): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtgaacaaccagttctccctgaaggtgacctctgtgaccgccgcggacacggccgtctattactgtgcgcggatttcagagggacaggactactatatcgacgtctggggcagagggaccacggtcatcgctcctcagcctccaccaacggggcccagtcggtcttcccccctggccaccctcctccaagngccacctctgggggccacagccggcctgggctgcctggtcaagggactacttcccgtgtctcgatctgagcgggctgggcaagggcgcatagcnnnnnnnnnnnnnnn

SEQ ID NO: 145035 - DNA, 587 bp, Homo sapiens
  misc_feature: GYAE6OF02JJ1K7.5.23.C01.1.454.CMB.1.raw
  modified_base (323)..(323): a, c, t, g, unknown or other
  misc_feature (323)..(323): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgccgaggagtccgggcccaggacgtggtgaacgcccgttccgggggaccccttcggtccctcacctgcgagtcgtttctcgtggcctcatcagcactattattggtggacctgggtccnccacgcccccgaaggaagaggctggagtggagtaggggagagtctagtcacgtaccgggagccaccaactacgaactccgtcccacagagtcgagtcacatatactatacgcacgtacaacactacttcctccgagtaggtacgaccttctcgtacgaccgccgaccgggaccgaccggtcccgtctattccgtgtcggccgtcggtaatttccgacggtacggaacgacggtaacctacgttacacgttacgacggttccggg

SEQ ID NO: 145036 - DNA, 440 bp, Homo sapiens
  misc_feature: GYAE6OF02H1PMV.5.23.C01.1.454.CMB.1.raw
  modified_base (423)..(440): a, c, t, g, unknown or other
  misc_feature (423)..(440): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccgaacgggcccatccggtccttcccccctggccaccctcctcccaagacgccacctcgtgggggcacagccggccctgggctgcctggtcaggactacttcccgtgtctgatcgtgacggcgggtcgtgggacgaacgggcgacatagnnnnnnnnnnnnnnnnnn

SEQ ID NO: 145037 - DNA, 634 bp, Homo sapiens
  misc_feature: GYAE6OF02HBX8Q.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggccaggactggtgaagccgttcggggaccctgtccctcacctgcgtatgtttctcgtggctccatcagcactattaattggtggtacctgggtccgccgacgtacccccgaggaaagacggctaggagtggtagttggggagatctatcacgtacgggacgcgaaccaactacaacgtcccgtaccctacaacgtacgtcgacgtacaaccagtactactatacgactacgtaccgaactaacctacgttcctacccgtagtaacggttctacccgttacgtacggtcggacccgtccggacggtaaccgaccgggacccgttacgtacgttaccgtgtccggtaccggtccggttacgttcggaacggtacgggtacgacgggtacctaacgttacgttacgtcggtaacgttccggg

SEQ ID NO: 145038 - DNA, 872 bp, Homo sapiens
  misc_feature: GYAE6OF02JFIUV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggacgtggtgaacgtccgttccgggggaccctcggtccctcgtaccctcggtccgtaagttcggtttccgtcggtgggtccctcccgtactaccgacgcctaaccgttaagtttaaacgtttcgggggtaggtaacccggttcgggggttaccccggacccggtacccggtacccccccgaaggggtaaaacggtacggggtacccgttaggggtaacgggttacgggggtagggtttacgggggggtaacgtaacgttaccgttaacgtttaccgaacgggttaacccggggaacggtaacccgtaaacccgtaaaccggttaaaccgtaaaaccgggttcccccgtaccccggttaaccggtaaacggtaccggtacgggtaaccgttacccgaaaccggtaacttacgttaaccgttaacgtaaaccgaacggtaacccgtaacccgtaaaccgtaaacccgttacgttaccctacccggttaggaacgtccggtaccttcgtaccgacggtacccgcccggtaccggaccgaccggtcccgttaacttaacgttccgttaggtaccgaccggtcggttaactttacggaccgggtaacggtacaaccgggtacccgtaagttacgaacgtacggtacgttacccgggg

SEQ ID NO: 145039 - DNA, 665 bp, Homo sapiens
  misc_feature: GYAE6OF02I52WB.5.23.C01.1.454.CMB.1.raw
  modified_base (318)..(318): a, c, t, g, unknown or other
  misc_feature (318)..(318): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttccggggaccctgtccctcaccgtgcgattgtttctcgtggctccatcagcactattaattggtaggacctggtccgaccncgcccccgaaggaaacgacggccgtggagtaggagttggggagatcgtatcgacgtaccgggagcaaccaactaaccaacgtcccgtaccctacgaacgtcgtacgaacgtccaacctactataccttaactaacgacctaacgtaccgaaaccaacgtacgttcctacccgtacgaaggttacgacccgttacgtacgtacggacccgtaccggcccggaccgaccgggtacccgttacgtacgtttaaccgtcggttacggaccggtacggttactttaccggaaggtaccgggtaacgaaccggtaaccgttaacgttacgttaacgtaccgtacggtcccggg

SEQ ID NO: 145040 - DNA, 627 bp, Homo sapiens
  misc_feature: GYAE6OF02IHWJC.5.23.C01.1.454.CMB.1.raw
  modified_base (331)..(331): a, c, t, g, unknown or other
  misc_feature (331)..(331): n is a, c, g, or t
  modified_base (429)..(429): a, c, t, g, unknown or other
  misc_feature (429)..(429): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggaccctgtccctcacctgcgatgtttctcgtggtctccatcagcactattaattggtgacctcgggtccgccacgcccccgaggaaagnggcgtggagtggagttggggagtatctatcgacgtaccgggagccaaccaactaacaacttcccgaccctacgaacgacgtcggagtccaaccaatanacttaatacgaacctacggtaccgaaaccaacctacgttccttacccgtagaacggtcgtacctcgtagtccgacccgtccggacggaccgaaccgggtccgtaccgttattaccgtgtcgtccggtacggtacgtttcggaaggtacgggaaccgtacggtaacttaacgttacgttacgtccggtaccgttacggg

SEQ ID NO: 145041 - DNA, 705 bp, Homo sapiens
  misc_feature: GYAE6OF02F4AGB.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggaccctgtcccctgacctgcgatgtttcgtcgtggcctccatcagcactattaagttggtcggtaccgtcgggtcccgccgaccgacccccgaaggaaacggacggtcgtggaggtacggtagttcggggagacgttctacgtacgacgtaccgggagtaccgaaccaaactaacctacgtacccgtacccgtacaacgtacgtaccggaacgtaccgaacctagttaacttaccgttaagtaaccgtaaccgtaccgtaacccgtaaacctaaacccgtacgtttaccctacccgttaagtaacggtacgtacccttcgtacgtccggacccgtcccggaccggaccgtacccggtaccgttacgtaacgttaccgttgtaccggtcggtacggttacgttaccggaacggtacgggtaacgtacggtaaccttacgtaactacgtaccggtaccgtacggg

SEQ ID NO: 145042 - DNA, 419 bp, Homo sapiens
  misc_feature: GYAE6OF02F7JJ7.5.23.C01.1.454.CMB.1.raw
  modified_base (409)..(419): a, c, t, g, unknown or other
  misc_feature (409)..(419): n is a, c, g, or t
tcagatcagacacgcacgaccggtgctcgatttagtacacgtgattagggattgggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagacgcacctcgtcgggggcacgagcggccccgtgggctgcctggtcaaggactacttcccgtgtctgatctgagcgggctggacaggcgcatagnnnnnnnnnnn

SEQ ID NO: 145043 - DNA, 637 bp, Homo sapiens
  misc_feature: GYAE6OF02FTW1D.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccgttcggggaccctgtccctcacctgcgatgttctcgtggctccatcagcactattaattggtggacctgggtccgccacgcccccgaaggaaacgaggcgtaggagtgggagttggggagatacgtatcgacgtaccgggagacgaaccaaacgtaacctaacgtcccgtacccctacgaaacggtacgtcgtacgtacctaaccgatactctaactaacgacgtaaccgtaccgaaaccaaacctacgttaccttcccgtagtaacggtcgtacccttcgtacggtcggaccggacccggtaccgggaacctacccgggccgttacttacgttaaccgtggtcgccggtacggtagttccgtaaggacggacgacggactaactagtactacgacgtacggg

SEQ ID NO: 145044 - DNA, 441 bp, Homo sapiens
  misc_feature: GYAE6OF02F7OV1.5.23.C01.1.454.CMB.1.raw
  modified_base (430)..(441): a, c, t, g, unknown or other
  misc_feature (430)..(441): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcacgcctccaccaacgggcccagtccggtccttccccccgtggccacccctcctcccaagacgccaccctcgtgggggccacgacgccggccgtcgggctgccgtggtcaaggactaccttcccggtgtctgactctgaggcgggctggacgaacggcgacatagnnnnnnnnnnnn

SEQ ID NO: 145045 - DNA, 570 bp, Homo sapiens
  misc_feature: GYAE6OF02GB58R.5.23.C01.1.454.CMB.1.raw
  modified_base (492)..(492): a, c, t, g, unknown or other
  misc_feature (492)..(492): n is a, c, g, or t
  modified_base (512)..(512): a, c, t, g, unknown or other
  misc_feature (512)..(512): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcggcccaggactggtgaagccttcggggaccctgtccctcacctgcgatgtttctcgtggctcatcagcactataattggtggacctggtccgccacgcccccgaaggaacgaggcgtacggagtcggagttggggagtacgtctactcgtactaccgggagaccaacgaactaactaactcccgtcccacgaagagtacgagtacacctatatactatacgacacgtacaacaaccattccaccgtagaggtctacctctgtcgacccgcgacggaccncggtccgtctacttactcgngcggcggtacttcgaaggaggacgacggtactaccgtagtacgtaccggtgtaccggg

SEQ ID NO: 145046 - DNA, 595 bp, Homo sapiens
  misc_feature: GYAE6OF02FY3WU.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaacgccgttcggggaccctgtcccctcacctgcgatcgtttctcgtggctccatcagcactattaattggtggacctgggtccgccacgcccccaggaacgaggctggagtggagttggggagattcgtatcagtaccgggagacgaccaactacaactcccgtaccctacaacgtacgtacgaagtcaacccgattactactatacgaaccacgtaccaaaccgaaacctacgtttacctacccgtagaacggttacgaccgtcgtagtaccgaccgtccggacgacgaccggtccgtctacgttactgtacgcggtcggtattcgaggacggacgaggacttacgtaatacgtacgacgtcggg

SEQ ID NO: 145047 - DNA, 626 bp, Homo sapiens
  misc_feature: GYAE6OF02GC1Q3.5.23.C01.1.454.CMB.1.raw
  modified_base (365)..(365): a, c, t, g, unknown or other
  misc_feature (365)..(365): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcgaggagtccgggcccaggactggtgaacgtccgttccgggaccctcgtccctcaccgtgcgatgtttcgtcgtggctccatcagcactattaagttggtcgaccgtggtcccgccacgcccccgaaggaacgacggcgtcgggagtggagttggggaanagtctatcacgtaccgggacacaaccaaactacaacgtcccgtccctacgaacgtacgtcgagtaccacatactacatacgacacgtacgaaccaacctgtttacccaccgtagtaacggtcgtacccgttctacggtcgaccggtcccggaccggacgacccgggccgttacgttacgtttacgtcggtacgccggtacggtactttacggaacggtacggaccgacgtacttaacgtagtacgtccggtacgttacggg

SEQ ID NO: 145048 - DNA, 589 bp, Homo sapiens
  misc_feature: GYAE6OF02IJMCO.5.23.C01.1.454.CMB.1.raw
  modified_base (357)..(357): a, c, t, g, unknown or other
  misc_feature (357)..(357): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactatttaagttggtggaccgtgggtcccgccgacgccccccgaggaaacgaggctgggagtggagttgggganagtctatcagtaccgggagacgaccaactacaatccgtacccacgaagacgtacgagtaccaccatactactatacgactacgtacgaacacctagttcctacctgaacggtcaccttcgtcgtcgaccgccgaccgacgaccggccgtactacgttacctcggtgccggacggttcgttcgaacggacgggaaccgacggtactaccttagtacgttccgacgttaccggg

SEQ ID NO: 145049 - DNA, 549 bp, Homo sapiens
  misc_feature: GYAE6OF02FULGX.5.23.C01.1.454.CMB.1.raw
  modified_base (432)..(432): a, c, t, g, unknown or other
  misc_feature (432)..(432): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggccaggactggtgaagccttcggggaccctgtccctcacctgcgatgtttctcgtggctccatcagcactattaattggtggacctgggtccgccagcccccaggaaagaggctgggagtgggattgggggagatctatcataccgggagcaccaactacaatccgtccctcaagacgtcgagtcaccatatctatagacacgcgaacaccagttcnccctgaaggtcaccgtctgtcgacccggccgcggaccacggccgtctattcctgtgccgtggactttcgaggacgggacgaggtaccttaaccgtagttactacgtagttacccggg

SEQ ID NO: 145050 - DNA, 569 bp, Homo sapiens
  misc_feature: GYAE6OF02FK0I9.5.23.C01.1.454.CMB.1.raw
  modified_base (291)..(291): a, c, t, g, unknown or other
  misc_feature (291)..(291): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (502)..(502): a, c, t, g, unknown or other
  misc_feature (502)..(502): n is a, c, g, or t
  modified_base (522)..(522): a, c, t, g, unknown or other
  misc_feature (522)..(522): n is a, c, g, or t
  modified_base (539)..(539): a, c, t, g, unknown or other
  misc_feature (539)..(539): n is a, c, g, or t
  modified_base (554)..(554): a, c, t, g, unknown or other
  misc_feature (554)..(554): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagcctcccagatcgggccctgtctcgaggtgcagctgcaggagtccgggccaggactggtagaacgccgttccggggaccctcgtcccctcaccgtgcgatcgtttctcggtggcctccntcgagcactattaagttggtcggacgtcgggtccgccaccgccccgaaggaagcggctgggagtggagttgggganatntatcgacgtacgggnccaaccaatacactcccgtacctacgagcgtacgagtccaccatatctaatacgacacgtacgaaccaccgtacttcctacctagacggtcgactcgtgtccgaccgcgaccggacncggtccgtactactcgtcgngcgtcggtatcgaaggnggacaggtacctatntacgtcgacgttcgg

SEQ ID NO: 145051 - DNA, 612 bp, Homo sapiens
  misc_feature: GYAE6OF02J1AQP.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcaggtgcagctgcaggagtcgggcccaggacgtggtgaacgtccgttcggggaccctgtccctcacctgcgatgttctcgtggcctccatcagcactattaagttggtcggaccgtcgggtccgccgtacgacccccgaggaacgaggcgtaggagtcggagtgggagatctatcgagtaccgggagacaaccaactaacacgtacccgtaccctacgaagtacgtacgacgtaccaactacgtactacgtaacgtaacgtaaccgacgtacgaacctaaccgacgttcctacccgtagaacgtcgtacctcgtcgtacgacccgccgacgtaccgaccggtccgacttacgtacgtgcgtcggcgtacgttcgacggtacggtacgacggtacctagtacgtactacggtacgtcgg

SEQ ID NO: 145052 - DNA, 663 bp, Homo sapiens
  misc_feature: GYAE6OF02JS589.5.23.C01.1.454.CMB.1.raw
  modified_base (201)..(201): a, c, t, g, unknown or other
  misc_feature (201)..(201): n is a, c, g, or t
  modified_base (335)..(335): a, c, t, g, unknown or other
  misc_feature (335)..(335): n is a, c, g, or t
  modified_base (419)..(419): a, c, t, g, unknown or other
  misc_feature (419)..(419): n is a, c, g, or t
  modified_base (613)..(613): a, c, t, g, unknown or other
  misc_feature (613)..(613): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctccgtggtggcagcctcccagatgggccctgtctcaggtncagctgacaggagtcgggcccaggacctgggtgaacggcccgttacggggaccccttcgtcccctcacctggcgtagtcgtttctcgtggtactccatcacgctactattaagtcggtacggccgtcgggtccnccgaccgtacccccgaagggaacgacgggtacgtaggtaggtcgggtagttaggggagaacttcgtaatcgaacgtaccggganaccgaacctaataaccacttcccgaccctacaggacgtcgaacgtccaacactatacgtaatcgtaacacgtacgaacctaaccgtcttacctccgtaaccgtaacggtctacccgtacgtacgtccggtacccgaccgggtaccgtaaccgccggtacccgtacgtacgttaacgcgttcgaccggtcggttnttacggacggtacggaccgacggtacattacggtacttcggaccgttcgg

SEQ ID NO: 145053 - DNA, 596 bp, Homo sapiens
  misc_feature: GYAE6OF02J0GPD.5.23.C01.1.454.CMB.1.raw
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (426)..(426): a, c, t, g, unknown or other
  misc_feature (426)..(426): n is a, c, g, or t
  modified_base (499)..(499): a, c, t, g, unknown or other
  misc_feature (499)..(499): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcgaggtgcagctgcgaggagtcggggcccagggacctgggtcgaaggccgttcggggaccctgtccctcacctgcgacttgttctcgtggctccatcagcactattaattggtggacctgggtccgccgacgtcccccaggaaacgnggcngggacgtggtagtggggagagtctatcgagtaccgggagcaccaactacacgtacccgtccctacaagctacgagtcaaccntactctaatacgacacgtacgaaacctaacgacgttactcccgtagaacggttcgacctccgtgtccggaccnccggccggaccacggtccgtacctattccgaggtcgtaccgcggtatttacgaggtacgggactaggaccctaagtacgtaatccggacgttacggg

SEQ ID NO: 145054 - DNA, 935 bp, Homo sapiens
  misc_feature: GYAE6OF02FSQK2.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagtctgcgaggacggtccgggaccgaggacgtggtagaacgtccggttccgggacccttccgtcccctctaccgtggccgtagttcgtttccgttcggtcggtccttaccgtaacgtcgacggactaccgttaagtttaacgttcgggtaccggtaccggttccgggtcccgacccgtacccggacccccgaaagggaaacgggacggtcgtacggggtaaggtaggggtaacgggttggggaacgtacgttaccgttaacgtaccgtaaccggttaacccggggacgtacccgtaaacccgtaaaccgttaaaccgtaacccgtttcccggtacccgtaccgtaaacggtacggtaccggtaacgtacccgtaaaccctaagtttaccgttacgttaaacgtacgtaaccccgttaacggtaacccgtaaaacccgtaacccgtttacccgtttacccgttacccggtaaacgttaaccgggttacctaacccgtttcgttaccggtacccgggtaccccggtaccgggtacccggtaacccgggacccgggttacccgtttaaccgttaaccgtttaacccggtttcggtaacccgggtacgggttccgggtttaaaccgttttacccggggaaacggggtttaaccccgggggaaacccgttaacgggtttaaccccgttaacggtttaaaccgttcccggtttaaccccgggtcccggtttaacccggggg

SEQ ID NO: 145055 - DNA, 650 bp, Homo sapiens
  misc_feature: GYAE6OF02JKCDC.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcaggtgcagctgcgaggagtccgggccaggactggtgaaggcccgttccggggaccctcgtcccgtccaccgtcgcgtattcgtttcgtcggtggtcctccatcagcctacttattaagttgggtcggaccgttcgggtccccgcccgtaccgacccccgagggaaacggacggtcgtggtaggtggaggttcggggaagtgtactagtacgacgtaccgggagtacaaccaactacaacgtcccgtacccgtacgaagacgtaccgactaccgaacctatactacttaagaacgtaacctaccggtaccaaacctaccgtacgttacctcccgtaagaaccggtcgaccgttacgtagccgaccgccggaccgaccgtcggccgtacgtacttacgcgtacggcggtcgtattcgaggaacggtcgacgtacgtactagtacgtacgacgttcgg

SEQ ID NO: 145056 - DNA, 855 bp, Homo sapiens
  misc_feature: GYAE6OF02JVHIT.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctctcctggtggcagctccagatgggcctgtctcgaggtgcagctgcgagggtagtcgggcccaggacgtgggtagaacgtccgttccggggacccttcgtcccctcaccgtggcgtattcggtttccgtcggtcggtcctccgtatcgacgctaacttagtttaaagttcgggtacggtaccgttcggggtcccgaccgaccggtacccccgaagggaaacggtacggccggtagggacgggtcggtaaggttcgggggaagtacgttctaacggtttacctaacggtaacccggggaacggtaacccgtaaaccgtaaaccgttaaccgtaaacccgtttaccccggttaccccggtaacgtaaacggttaccgggttacgtaaacccgttaccgaaaccccgtaacgttaacttaccgtaacgttaaccggaaacctaaccgggtaaccgaaaccgtaaccgttaccgttaacccgttccccgtaagggtaaacggttacccgtaccgttaccgttacgggtacccggaccccgggtcccgggaacccgggtaaccggttaaccccgggtacccggttaacgtaaccgtttcccgtacggttcggtaccgggtcgtttaaccggttcgaacgggtaaccggtacggtaacggttaaccttccggtaactacgttaccgggtaccggttaccgggg

SEQ ID NO: 145057 - DNA, 634 bp, Homo sapiens
  misc_feature: GYAE6OF02F6G35.5.23.C01.1.454.CMB.1.raw
  modified_base (256)..(256): a, c, t, g, unknown or other
  misc_feature (256)..(256): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtcgaacgccttcggggaccctgtcccctnaccgtgcgatgtttctcgtggctccatcagcactattaattggtggacctgggtaccgcgacgccccctaggaaacgaggctgggacgtgggagtttgggggagacgtactacgtcagtaccggggagaccaacccaaacgtaaccaacgttcccgtacccttacaacgacgtacgtagacctaaccactatacctaagtaacgaccacggtaccgaaacaaccgagttcctccctagaacgtcgaccttcgtgttcgacccgccggacgaccgacggtcccgtattacgttaccgttgacggcgtaccgggtactttccgaaggtacgggacctacggtaccttaacgttaatacgttaccggtacggttacccggg

SEQ ID NO: 145058 - DNA, 716 bp, Homo sapiens
  misc_feature: GYAE6OF02JZJMV.5.23.C01.1.454.CMB.1.raw
  modified_base (265)..(265): a, c, t, g, unknown or other
  misc_feature (265)..(265): n is a, c, g, or t
  modified_base (678)..(678): a, c, t, g, unknown or other
  misc_feature (678)..(678): n is a, c, g, or t
tcagatcagacacgcacgaccggtgctcgatttagtacacgtgattagggattgggcacgaccggtgctcgatttagtacacgtgattagggattggggagtactttctgagactcatggacctcctgcacaagaacatgaaacacctgtggttctcctcctcctggtggcagctcccagatggccctgtctcaggtgcagcctgcaggagtcgggccccaggaccgtggtggaaacgccttaccgggggaccctggtccccgtnacccgtgcgtagtcgtttctcgtcggccttccaacttcgacgcacgttattaacgttgggtacgtaccgttcgggtccaccgacggtcccccgaagggaacgtaacgggccgtagggacgttacgggagttacggggtacgacgtacggttaacgttaccgaacggtttacccggggaacgtaccggaacctaaacgttaaaccgtaaacggtccctaaccccggttacgaaacggttaacggtaccggtaacggttaccaaccgtacgtaaactacggttactaacgtaccgtaaccgtaaccggtaaacgaaacctaccgtacgttacccgtagacgtacgaccttcgtacgtcgaccgtacgaccggagacccggcgtactacgttacgctcggtacggtcgtattacgngacggtacgacggataccgaagtacgtcgtagtaccgg

SEQ ID NO: 145059 - DNA, 617 bp, Homo sapiens
  misc_feature: GYAE6OF02GC15N.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcagggagtccgggcccagggactgggtgaacgccgttcgggggaccctggtcccctcacctgcgatcgtttctcgtggctccatcagcactattaattgggtggtaccgtgggtccgcccacgacccccgaggaaagcggcgtgggagtgggagttggggagagtctagtcacgtaccgggagacgaccaacgtaacaactcccgtaccctacaagtacggtaccgagtaccaacctatactactaagtacgaaccacgtacgaaaccaacctacgtttacctaccctgtaacggtcgtacctcgtagtccgaccgccggcggtaccgacggccgttctacttaccgtgtcgcggtcggtacgtttcgaggacgggacgacggtaccttacgtatacgtcggtaccgtcggg

SEQ ID NO: 145060 - DNA, 749 bp, Homo sapiens
  misc_feature: GYAE6OF02FTCLG.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtccgggcccaggactggtgaacgccgttcggggaccctgtccctcacctgcgatgtttctcgtcggctccatcacgctactattaagtttgggtggtaccgtcggggttcccgccgaaccggaccccccgaagggaaacggacggaccgtgggaggtacgggtagttacgggggagtacgttcgtacttcgacggtaacccgggagaccgaacccaaacgtaacctaacgttccccgtacccgtaccgaaagtacggtacgaacggtaccaacccgaattaccgttactaagtaacgtaaccgaccggtaccgaaacctaaacccgtacgtttccctaacccgttacgtaaacgggttcgtaacccgttcgttacgtaccggacccgtacccgggaccggtaccgtaacccgggtaccgttaccgttaacgtttaccgtggtaccggtccgggtaccggttaagttttccggaacgggtaacgggtaacgtacgggtaacctaaccgttaacgtacggtaccggttaccgtaccgggg

SEQ ID NO: 145061 - DNA, 627 bp, Homo sapiens
  misc_feature: GYAE6OF02IY0K6.5.23.C01.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtncagctgcaggagtcgggcccaggactggtgaacgccgttcggggaccctgtccctcacctgcgtatcgtttctcgtcgctccactcagcactattagtggtcggacgtcgggtccgccacgccccgaggaaacgcggtctggtacgtggtagtagggactacgtctatacgtacgaccgggacgaccgaacctactacgaccgtacccgtcctacgagtacgacgtacgtacacgtaatactactacgacgaccgtaccgtaacgaacctaacgtcctttaccgtccgtaagtacgtacgtaccgttcgtacgtccgaccggccgtaccggaaccgtccggtcctaacgttacgttaccgtcgtcggacgtcggttacttcggacggacggtacgacggtactagtacgtacgtacggtacgtacggg

SEQ ID NO: 145062 - DNA, 478 bp, Homo sapiens
  misc_feature: GYAE6OF02IM9MK.5.23.C01.1.454.CMB.1.raw
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (439)..(478): a, c, t, g, unknown or other
  misc_feature (439)..(478): n is a, c, g, or t
tcagatcagacacgcacgaccggtgctcgatttagtacacgtgattaggggattgggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaaggcccatcggtcttccccctggcaccctcctccagacgcacctcgtgggggcacgacgccggcccgtgggcctcgcctggcgaacggactaccgttcccgngttcngtactcgtggaggcgggcgtagggccgtaaggggccgcgaacgtagntancngnnnnnnnnnnnnnnnnnnnnnnnnnnnnnnnnnnnnnnnn

SEQ ID NO: 145063 - DNA, 846 bp, Homo sapiens
  misc_feature: GYAE6OF02F7MR6.5.23.C01.1.454.CMB.1.raw
  modified_base (424)..(424): a, c, t, g, unknown or other
  misc_feature (424)..(424): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcgaggagtccgggccaggacgtggtgaacgccgttcggggaccctgtcccctcaccgtgcgtacttgtttcgtcgtggtcctccactcgacgctacttattaagttggtcgtaccgtcgggtcccgtaccgaccgtacccccgaaggaaacggacgggcgtggacggttgggtaacggtttgggggacgtagttcgtaagtacgtaacgtaccgggganaccgaaccaaacctactaaaccgtcccgtaccctacgaacggtacgtaccggaacgtaccaaccgtaattactaacgtaataaccggtaacctaaccggtaaccctaaaaccgtaaacccgttacgtttacccttaccccggttaagtaaaaccggggtttcgtaaaccccgtttcggttaccggtaaccgggtaaaccccgggtccccgggtaacccggggtaaaaccccgtaaccccggggtacccgtttaaccgtttaaaccgtttacccggttcgggtaacccgggtacccgggttaacgggttaaccttttaacccggggaaacgggttaacgggggtaaccgttaccgggttaaaccgtttaaacccggttaagtttaaacccgggttcccgggtaacggttttaaccccgggggg

SEQ ID NO: 145064 - DNA, 875 bp, Homo sapiens
  misc_feature: GYAE6OF02FI44V.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcaggtgcagctgcaggagtcgggcccaggactggtgaacgccgttcggggaccctgtcccctcaccgtgcgagtcgtttctcggtggccttccgatcgacgactactattaagttggtacggtaccgtcgggtcccgaccgaccgcccccgaagggaaacggagggtccgtagggtacggttcgggtaagttcggggggaagtacttaccgtaatccggtaaacggttacccggggaacgtaccgtaacccgtaaaacgttaaccgaaaccgttccccggtaacccgtaccgaaaggtaccggtaccggtaacgtacccgtaaaccgtacgttaacgttaccgttaacgtaaccgtaaaccgtaacccggttaaccgaaaacccggtaaacccttacggttttccctaaccccggttagggtaaccgggttaccctaacccgtttccgttacgggttacccggaaccccgggtccggtaaccggggtaaacccgttaccccggggtacccgtttacctttaaccggtttacccggttcgggttaccggtacccgggtttccgggttaaccgttttaacccgggtaaccggggttaaaccggggtaacccgttaaacggggttaccctttaaaccgggttaaacgtttacccggttaccgggtaaccgggtttacccggggg

SEQ ID NO: 145065 - DNA, 906 bp, Homo sapiens
  misc_feature: GYAE6OF02JPCRV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctcctggtggcagctcccagatcgggccctgtctcaggtgcagctgcgagggacgtcgggcccaggcgtggtgaacgtccgttcggggaccctcggtccctcgaccgtgcgtattcgttccgtcgtcggtctaccgatcgacgtcctaacttagttaacgttcgggtacggtaccgtcgggtcccgccgaccgtacccccgaaggaaaggacggtcgtagggtacggtaggtaggttcggggaagtacgtacgtacgtacgtaacggtaaccggggtaacgaccggtaaacccgtaaacgtaaccgtaaaccgttcccggtacccgtaaccgtaaacggtacgtaccggtaacgtaaccgtaacgtaaccgttaataccgttaaacgtaacggtaaaccgtaacccggttaaccgaaaaccgtaaacccgtttaacgtttaacccgttaccccgtaagggtaaaccggttaccggtaacccgtttacccgtacggtttaacccggggaaccccgtacccgggtaacccgggaacccgttaaccccgggttacccgttaaacccgtttacgttaaacccgggtttccgggtaccgggttaccccgggtaaaccggggttttaaaccgtttaacccgggaaaccgggggttaaaccgggtaaaccgggttaaacccgggttaacccgttaaacccggtttaacggttaaacccgggtttcccgggtaaaccgggtttaccccggggg

SEQ ID NO: 145066 - DNA, 505 bp, Homo sapiens
  misc_feature: GYAE6OF02J2A2P.5.23.C01.1.454.CMB.1.raw
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (470)..(505): a, c, t, g, unknown or other
  misc_feature (470)..(505): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctatactgtgcgcggtatttcaggagggacaggactactatatcgacgtcgtggggcagagggaccacggtcagtcgtctccgtcacgcctccacaacgggacccagtccggtccttccccctcggcccacccgtccctccgaagcgccaccgtcgtcgggggcaaccgcggcccggcccgtgggcctcggccgtggtacaacggtaccttaccttcccggtgttccgtagtactcgtcgtacggccgggtcgtcgggcgaacgggtcggacagtagnacgtncgnnnnnnnnnnnnnnnnnnnnnnnnnnnnnnnnnnnn

SEQ ID NO: 145067 - DNA, 763 bp, Homo sapiens
  misc_feature: GYAE6OF02IQJXI.5.23.C01.1.454.CMB.1.raw
  modified_base (313)..(313): a, c, t, g, unknown or other
  misc_feature (313)..(313): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaaccacctgtcggttcctcctcctccgtggtggcagcctcccagagtcgggccctgtctcgaggtcgacgagctgacgagggacggtccgggaccctaggtacgtggtacgaacgtcccggttccgggacctcgtccctcaccgtgctattcgttctcgtggcctcactcgancacttagtttagttcgggtcggtaccgttacgggtcccacgaccggacccccgaaggtaaacgcggtaccgtggaggtacggtaggttcggggaactagtacctacgtacgaccgtaccgggaacaccgtaaccgaaactaacgacttccccggtaccctaacgtaacgtaccgtacgtacgtacccaaccgtaatacgttaccgtaagaaccgtactaaccggttaaaccgaaacccttaaccgaaccgtttccctaacccggttaacggtaaccgttccgttaccgtaccggttaccggaccggtacccgacccgggcggaaccccgtaccggttacctaccgtttaacgttacccgtgttacggtacccggtcggttaaaccgtttgaaccggggtacggaactaccgggttactaaccgttagtaccggttaccgtacgttcgggg

SEQ ID NO: 145068 - DNA, 729 bp, Homo sapiens
  misc_feature: GYAE6OF02IBHB3.5.23.C01.1.454.CMB.1.raw
  modified_base (610)..(610): a, c, t, g, unknown or other
  misc_feature (610)..(610): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcgaggtgcagctgcgaggagtcgggccaggacgtggtgaacgtccgttccggggaccctcgtaccctccaccgtgcgtattcgtttcgtcgtgcctcctatcacgctacttattaagttggtacggtaccgtcgggtccgccgaccgtacccccgaaggtaacggcgcgtggaggtaggtaggtcggggagtacgtactagtacgaacggtaccgggagtaccaaccgtaacctaaacgtaaccgttaccccgtcccgtaacgaacggtacggttacgaccgtaccgtaacccgtaactaacgtacgttaacgtaacgtaaccgtacgtaaccgtaaacctaaccgtacttacccgtaccctaaggtacggtccgtaccgttcctacgggcccgtacccggccggacccggtaacncccgggtactccgttacttaccgtggttaccgccggtacggttaccgttacggtaacgggaacgggtaccgtacgggtaaccttaccgtaaggttccgtaccggtaccggttaccgggg

SEQ ID NO: 145069 - DNA, 443 bp, Homo sapiens
  misc_feature: GYAE6OF02I8MJQ.5.23.C01.1.454.CMB.1.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (412)..(443): a, c, t, g, unknown or other
  misc_feature (412)..(443): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctatactgtgcgcggatttcagagggacaggactactatatcgacgtctggggcagagggacccacggtcatcgtctcctcagcctccaccaagggcccatccggtacttcccccctggccaccctcctccaagagccacctctgggggcacagccgcctggctgctgtcaaggactcttccgtgtctgatctgagcggctgggctaaggcgacagtacgngtnagtnnnnnnnnnnnnnnnnnnnnnnnnnnnnnnnn

SEQ ID NO: 145070 - DNA, 506 bp, Homo sapiens
  misc_feature: GYAE6OF02G4M1N.5.23.C01.1.454.CMB.1.raw
  modified_base (482)..(482): a, c, t, g, unknown or other
  misc_feature (482)..(482): n is a, c, g, or t
  modified_base (484)..(506): a, c, t, g, unknown or other
  misc_feature (484)..(506): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggtatttcaggaggacaggactactatatcgacgtctggggcaggagggaccacgggtcagtcgtctcctcacgccctccaaccgaacgggcccacgtccggtaccttccccccgtggcccacccctccctaccgaacgacgccacccgtcggtcgggggaccaccgacggcccggtcccgtcggggcctcggcccgttggtacgaaacggtaccgttacgttccccgttgtcccgtagtactccgtgggacggcgggtacgtcgggacgacgggcgcagtagngnnnnnnnnnnnnnnnnnnnnnnn

SEQ ID NO: 145071 - DNA, 769 bp, Homo sapiens
  misc_feature: GYAE6OF02FZ3JA.5.23.C01.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttctcctctcctggtggcagctcccagatgggccctgtctcaggtncagctgcaggagtcgggcccaggactggtgaagccttggggaccctggtccctcacctgcgatgtttctcgtggctccatcacgtcactattaattcggtggtaacctggggttacccgccgtacggaccccccaagggtaaacgacgggtcttacgggaggttagggactttacgggggaacgtagttcgttaacgtccgtaagttaacccgggggaagtacccgaaccaaaccgtaaccgaaacgttccccggtaaccccttaccgaaagtacgtaccgtaacgttaccgaacctaacgtacttacgtactaagaacctacggtaccggtaaactaaaccgacgtttactaccccgtaggtaaaccggttacgaacccgttacgttacgttaccggaacccgtacccggacgggtaacccgtaaccgggtaccccggttactttaaaccgttaccgttacgggttccgaaccgggtccggtaaccgtttttaaccgaacgggtaacgggtaaccgtaacgggttaaccctaaaccgttacgtaaacgttaccggtaccggtttaaccggg

SEQ ID NO: 145072 - DNA, 692 bp, Homo sapiens
  misc_feature: GYAE6OF02IUSW2.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagctcccagatgggcccctgtctcgaggtgcagctgcaggagtcgggccaggactggtgaacgtccgttccggggaccctcggtccctcaccgtgcgtatgtttcgcgtcggtctccatcacgctacttattaagttggtacggaccgttcgggtcccgaccgaccggaccccccgaagggaaacgacggtcggtacgggtaggtaggggtaggttggggaagtacgtacgttaagtaccgtaacggttaaccggggacgaccgtaaccctaaaccgtaaccgtaaccgttaccccggtcctactaaacgggtacgtaccgacgtaccaacgtaactactactaacgtaacgtacaccgtacgaaaccaacctacgttacctaccgtagtaacggctaccttagtcgtacgacccgtaccgaccggtacgtaccggtaccgtaccgttattaccggtagtcgacgtcggttacttacgaggacggtaactcggaactacgttatacgttacgccggttacgg

SEQ ID NO: 145073 - DNA, 710 bp, Homo sapiens
  misc_feature: GYAE6OF02J25NM.5.23.C01.1.454.CMB.1.raw
  modified_base (403)..(403): a, c, t, g, unknown or other
  misc_feature (403)..(403): n is a, c, g, or t
  modified_base (559)..(559): a, c, t, g, unknown or other
  misc_feature (559)..(559): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttccctcctcctcctggtggcagcctcccagacgtgggcccctgtcctacgaggtgcagcgtgcgagggacgtccgggcccaggccgtggtagaacggtccgttccgggaccctgtccccacaccgtgcgtattcgtttcgtcggtcggcctacctagtccacgtcctaacgttatttaaggttcggtcggaccgtcgggtcccaccgaccgaccccgaaggaaagcggctgggtagtcggtaggtgggganactcgtagtaccgagtaaccgggcaacaaccgaactaccgtactcccgtacccgtagtaacgacggtaccgtacgaccacaacgttactacgtaacgtataaccggaccgtaccgaaacctaccgttacggttaccctaccggtagtacggtaccnccttacggtcgtaccggacccggtaccggtaccggaacccgcggtcccgttacgttaacttcgacgggttcgaccggtacgttcttacgggaccggtaaccggaagtaccggtacttaaccgttgaccgttaccgggtcgttaaccggggg

SEQ ID NO: 145074 - DNA, 949 bp, Homo sapiens
  misc_feature: GYAE6OF02FYSJH.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagtctgcagggacgtccgggccaggacgtggtagaacgtccgttccggggacccttcgtcccctcaccgtgcgtattcgtttctcgtggcctcctatcagcacttattaagttgggtacggtacccgtgggtccccgccgtaccggaccccccgtaaagggaaacggacgggtacgtagggtacggtacggggtaagggttagggggtaacgtacgttacgttaacgtaccgtaacgggttaacccggggaacgacccgtaaaacccgtaaacccgttaaccgtaaaccccgttaccccccggtaccccttaaaccgtaaacgggtaaccgggttaaccgtaacccggttacccgtaaaacccgtagtttaaccgttaaacccgttaaaggtaaacccggtaaacctaaacccgggttaacccggaaaaaccccttaaaacccgttccgttttaaccccggttaacccccgttaagggtaaacggggttacccgttaaccctttaaccgggttaccggttacccgggaaacccccgtccccggggtaaccggggtaaaccccgttccccggggtacccggtttaacccgttttaaccgtttacccgggttaccgggttccggtacccgggtttaccgggttaaacggtttttacccggaaagggtaacccggggttaacccgaaacgggtttacccttaacccggttaaagtttacccggtttaccggtaacccgggtttacccggggg

SEQ ID NO: 145075 - DNA, 948 bp, Homo sapiens
  misc_feature: GYAE6OF02GCTFU.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcgaggtgcagctgcaggagtcgggccaggactggtgaacgccgttcggggaccctcgtcccctcaccgtgcgtattcgtttcgtcgtcggccttaccgatccgagcctaacttatttaagttcgggtcggtacccgtggggttccccgaccctaccggaccccccgaagggtaaacggacgggtacgtacgggagttacggggtagttagggggacgtaagttacctaagtaccgaacggttaacccggggacgtaccgtaaacccgtaaaccgttaaaccgaaaccgtttaccccgttaccccgtaacccgtaaacgggtacggttaccggtaaccgttacccgtaaacccgtaacgtttaacgttaccgtttaaacgtaccggtaaaccgtaacccggttaaacccggaaaccctaaaaacccgttaccggttttacccttaaccccggttacgggtaaacgggttacccgtaaacccgtttccggttaccggttaacccgggtacccccggtacccggggtaacccgggaacccgggttaacccggtaccccggtttaaaccgtttaacccgtttacccgtttaccgggtacgggtaccccgggttaaccggggtttaaccctttttaaccggggaaccggggttaaaccgggggttaaacccggtaaccggggtttaaaacccgtttaaacccggtttaaacgggtttaacccggttaacccggggttaacccggtttaccccggggggg

SEQ ID NO: 145076 - DNA, 947 bp, Homo sapiens
  misc_feature: GYAE6OF02GOLGY.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcaggtgcagctgcaggagtccgggcccaggactggtagaacgccgttaccggggaccctcgtccctcaccgtgcgacttcgtttctcgtggcctaccatcgacgcacttaagtttaacgttgggtacggtacccgttacggggtccccgaccgtacccggacccccggaaagggtaaaggaccgggtcgtaagggtaacggttgggtaacggtttacgggggaacgttaacgtaccgttaacgttaccggtaaaccggtaaacccgggggtaacgaaccgtaaacccgtaaaacccgttaaccgtaaacccgtttcccccgggttaaacccccgttaacgtaaaacgggtaccgggtttaacccggaaaccggttacccctaaaacccgttaagtttaaacccttaaccgtttaaacgtaaacccgggtaaacccgtaaacccgggttaaacccggaaaaacccttaaacccggtttaaccgtttaccccgtacccgttaaacgggtaaacccgggttaccgaacccgtttaccggtacgggttaacccggaccccgggaccccgggtaacccgggtaacccgaaccccggggttacccgtttaaccgtttaacggttaacccgtttcggggaaccggtccgggttaaccgggtttaacgttacccgggaacggggttaaccgggaaccgttaaacgggtaacccctttaaaggtaacccgttaggttacccggtaccgggtttacccggggg

SEQ ID NO: 145077 - DNA, 889 bp, Homo sapiens
  misc_feature: GYAE6OF02H46QU.5.23.C01.1.454.CMB.1.raw
  modified_base (167)..(167): a, c, t, g, unknown or other
  misc_feature (167)..(167): n is a, c, g, or t
  modified_base (181)..(181): a, c, t, g, unknown or other
  misc_feature (181)..(181): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagacatagaacacctgtggttcctcctcctcctggngcagctcccagagngggccctgtctcgaggtcgcgagctgacgagggacgtcgggcccgaagggaccttgggagaacggtcccgttaccgggggacccttcggtcccctaccgtaccgtcgtacgtagtttcgtttccgtacggtcgggaccttacccgaattccgaaggtcctaaaccgttaaagttttaaacggttcgggttacgggtaacccgtttcggggttaccccgacccggtaacccggaccccccggaaagggaaaaacggtccgggtacggtacggggtacggtaggggtaacggtttacggggggaactaacgttaccgttaacgtaccgtaaaccgggtaacccggggtaacgaacccgtaaaacccgtaaacgtaaaaccgtaaccgttaccccggttacccgtaacggtaaaacgggtacggttaccggtaaaccgttaccgaaaacccgttaataaccgtttaacgtaaagtaacccggtaaacctacgggttaaacccaaaaccgttaaaccgttacgtttaacccgttaccgttaagggtaaccgtaccgtaccgttacgtcggttaccgacccgggtacggaccgggtaaccgtccgggccttaagtaacctttcgggtacggacgtaccggtacgttaacggtttggaaccgggtaggaccgtaggttaacccgacttaaggtacgtaccggacggttaacggg

SEQ ID NO: 145078 - DNA, 639 bp, Homo sapiens
  misc_feature: GYAE6OF02GE73E.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggccaggactggtgaagccttcggggaccctgtccctcacctgcgatgtttctcgtggctccatcagcactattaattggtggtaccgtcgggtccgcccacgcccccgaaggaacgacggcgtggacgtggtacgttggggagtagtcgtatcgacgtacgggagacaacaactacaactccgtaccacaagagtacgacgtacacatactctaatacgaccaacgtaccgaaacctaacctacgttacctaccgtacggtaacggtcgaacccttcgtacgtacgacccggaccggaccggaaccgacccggtacccggtacttacgttacgttcgtacggaccggtcggtagtttaccgaacgggtacgggaaccgtaacgggtaccttaaccgttaactacgttaccggtacgttaccggg

SEQ ID NO: 145079 - DNA, 617 bp, Homo sapiens
  misc_feature: GYAE6OF02FVSYX.5.23.C01.1.454.CMB.1.raw
  modified_base (384)..(384): a, c, t, g, unknown or other
  misc_feature (384)..(384): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcagggagtccgggacccaggactggtcgaacggccgttccggggaccctggtcccctcacctgcgatgtttctcggtcgctccatcagcactattaagttggtggaccgtgggtccgccacggcccccaaggaacggaggctgggagtggtagtggggagatctagtcacgtaccgggngacaacctaactaccacgtcccgtccctacgaacgacgtcgacgtccaacctatattctatacgccacgtacaaccaacctagttccctaccgtacgtaggtcgaccttcgtcgtacggacccgccggtacgacgtacccggcgttcttacttacgtcgtacggccggtcgtagtttcggaaggtacggacgaacggtacttaacgttaacgtacgtacccggtgttaccggg

SEQ ID NO: 145080 - DNA, 445 bp, Homo sapiens
  misc_feature: GYAE6OF02I3VT9.5.23.C01.1.454.CMB.1.raw
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
  modified_base (431)..(445): a, c, t, g, unknown or other
  misc_feature (431)..(445): n is a, c, g, or t
tcagatcagacacgcacgaccggtgctcgatttagtacacgtgattagggattgggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcaggagggacaggactactatatcgacgtcgtggggcaggagggaccacggtcatcgtctcctcagcctccaccaacgggcccatccggtcttcccccnggccaccctcctaccaacgacgcacctcgtcgggggccacgacggccggcccgtcgggctcgccgtggtcaaggacttaccttcccggtgtctgatctgnggcgggtctggcgagggccgacatagnnnnnnnnnnnnnnn

SEQ ID NO: 145081 - DNA, 841 bp, Homo sapiens
  misc_feature: GYAE6OF02IVU4X.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagagtcgggccctgtctcaggtgcagctgcgaggacggtccgggcccaggtaccgtggtacggtaacggtcccggttacccggggtaccccttcggtacccctccgaccgttcggccgtacgtttcgtttccgttacggtcggtccgtccctactacgacgacctacttaagtttaacgtttgggttacggtaccgttcggggttccccgacccgtacccggtaccccccggaaaggggaaaccgggtacgggtacggtacgggtaacggttagggtaggttacgggggagtacgttacgtaacgtccggaacggtaaccggggacgaccgaaaccctaaaccgtaacctaaaccggttcccgttacccctacgaacggtacgtaccgtaacgtacccaacccgtaagttaaccttaccgttaacgtaacgttaacccgaaccggttaaccaaacctaaacccgtttaacgttacccctacccgttaacgggtaaacgtccgtaccctcggtttacggtaccggtaccccgacccgggtacccggaaccgtacccgggtccgttacgtacgtttaccggtacgtacgggtccggttacggtacgttacggacggtaacgggactacgggtactaagtacccgtagttacggtaccggttcggg

SEQ ID NO: 145082 - DNA, 558 bp, Homo sapiens
  misc_feature: GYAE6OF02GF7BM.5.23.C01.1.454.CMB.1.raw
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctcgcaggagtcgggccaggactggtgaagccgttcgggacctgtccctnacctgcgatgttcncgtgcctcntcagcactattagtggtgaccgtggtccgaccacgccccgaggaacgaggtcgtggagtggagttgggganagtcgtatcgacgtacggagccaaccgaactacgaacttcccgtcctacgaagacgtcgagcactatactatanaagctacgtacgaaccactacgttcacctagacgtctacctntacgcgaccaccggacgacgtaccggactcgtactacgtgtacgcggtcgttaattcggagacggtacgacgtactactatacgtccgtacgtcgg

SEQ ID NO: 145083 - DNA, 565 bp, Homo sapiens
  misc_feature: GYAE6OF02JKW4L.5.23.C01.1.454.CMB.1.raw
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctacttactgtgcgcggatttcagagggacaggactactatatcgacgtcgtggggcaggacgggaccacggtcagttccgtacctcctacacgcctccgacccgaacgggcccatccggtaccttcccccctcgggccaccccgtcccttaccgaacggacgcctaaccgtccgtcgggggtcaccgacgcggcccgttcgggctcgcgtcgacgaagacgtaccttccgtcgtcgcgactctcgacggtcggggcgtcggacgaacggtccgctaacgacgtcgcgttancgngagtcacgngtcnctacgnaagtcncgttcagtgactcggancgncngntcngngncgcncgtcgcgcgcgcgcgtngcgacgncg

SEQ ID NO: 145084 - DNA, 650 bp, Homo sapiens
  misc_feature: GYAE6OF02HUSE1.5.23.C01.1.454.CMB.1.raw
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (546)..(546): a, c, t, g, unknown or other
  misc_feature (546)..(546): n is a, c, g, or t
  modified_base (556)..(556): a, c, t, g, unknown or other
  misc_feature (556)..(556): n is a, c, g, or t
  modified_base (559)..(560): a, c, t, g, unknown or other
  misc_feature (559)..(560): n is a, c, g, or t
  modified_base (563)..(563): a, c, t, g, unknown or other
  misc_feature (563)..(563): n is a, c, g, or t
  modified_base (566)..(567): a, c, t, g, unknown or other
  misc_feature (566)..(567): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (587)..(588): a, c, t, g, unknown or other
  misc_feature (587)..(588): n is a, c, g, or t
  modified_base (595)..(595): a, c, t, g, unknown or other
  misc_feature (595)..(595): n is a, c, g, or t
  modified_base (604)..(604): a, c, t, g, unknown or other
  misc_feature (604)..(604): n is a, c, g, or t
  modified_base (611)..(611): a, c, t, g, unknown or other
  misc_feature (611)..(611): n is a, c, g, or t
tcagatcagacacgcacgaccggtgctcgatttagtacacgtgattagggattggggagatctatcataccgggagcaccaactacaatccgtcccgtcaagagtcgagtcaccatatctatagacacgtacgaacaaccaggttcctcccctgaaggtgacctntgtacgaccgccgcggacnccgccgtctatctgtgcgngattcgagaggacaggactactatatcgacgtctggggcaggacgggtacacgggtcagtccgtctctcctacgccctaccaaccgaacggggaccccagttaccccggttccttccccccgtaggtaccccaccccgtaccctaccgaacggtacaccgtaccctcgggtacggggacctacccggtaggtacccgggtcccgtacgggtccgtccggccgttagggtaccgaacgggttaccttaaccgttcccggttacgtccgtacggtaagttccgtaacgggtcggggtccgggtaccgtcgggaacgggaccgttcgggaaactggtaacgcgagngtactagctntannctncgnngcgactacactntntaatannacgtatntgacgtgtntccaganactacgtagactagcgcggtagtacgacgtacgtacgag

SEQ ID NO: 145085 - DNA, 589 bp, Homo sapiens
  misc_feature: GYAE6OF02G62ZT.5.23.C01.1.454.CMB.1.raw
  modified_base (334)..(334): a, c, t, g, unknown or other
  misc_feature (334)..(334): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgagccgttcggggaccctcgtccctcacctgcgatgtttctcgtggctccatccagcactattaattggtggaccgtcgggtccgccgacgcccccgaggaaacgnggctggacgtggagttggggagatctatcagtaccgggagcaaccaactacaactcccgtcctacaagcgtacgactcaccatactctataagacaccgtaccgaacaaacctacgttcctccctacgtaacggtacgacccttacgttcgtacgacccgaccgcggaaccgacggaccgtactacttacgtcgtcggccgtcggtacgtttcgaaggacggacgacggtactacgtatacgtcgtacgtacggg

SEQ ID NO: 145086 - DNA, 873 bp, Homo sapiens
  misc_feature: GYAE6OF02JL34J.5.23.C01.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcaggtnccagctcggcgaggagtccgggcccagggacctggtgaacggtccgttaccggggaccctgtacccctcgaccgtgcgtactgtttcctcggtagcctccatcgacgtctacttagttaacgttggtacggtaccgttacggggtaccccgtaccgtaccggaccccccgtaagggaaacggaccgggtccgttacgggtacggtggggtacgttagggggacgtacgttaccgttacgtacgtacggtaaccgggacgtaccgaaccgtaaccgtaacgaaccgtttacccgtacccgtaaccgtaacggtacgttaccggtaaccgttacccgaaccgtaaccgtttaactaaccgttactaaacggaacccgtaacccggtaacccgtaaaacctaaccccggttaacgtttaccccgtaccccgttaaggtaaaccgggttaccgtaacccgttacgtttaccgggtaaccccgggtaccccgtaaccccgggtaaccgggaaccccgtaacccggggtaccccgtttacccgttaaccgtttaccgggttcccgtaaccgggtcccggttaacccggggttaccgtttacggaacggggtaaccgggaaccggtacggttaacccgttacgttaaaccgttcggtaccggtacccggtttaaccgggg

SEQ ID NO: 145087 - DNA, 890 bp, Homo sapiens
  misc_feature: GYAE6OF02IA2WF.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaaccacctgtggttccctcctccttcctggtggcagcctcccagagtcgggcccttgtctcgaggtgcagcgtcgcgaggtacggtcgggcccgaggacgttgggtacggaacggtcccggttaccggggtacccttcggtcccctaccgaccgttcggacgtacgtttcggttttccgtcgtcgggtccctacactcacgctaacttaatttaagtcgggtacgtaccgtcgggtcccgccacccggaccccgaagggaacggcggtcgtacgggtaacggtgggtacggttacggggagtaacgttccgtagtaactaccgggtaaccgggacgtaccaaccgtaaaccgtaacgtaaccgttaccccgtacccgtaacgaacggtacgtacggtaacgtaccctaaccgttactaacttaccgtaagaccgtaaaccgtcccgtaaacgtaaaccctaacccgtttaaccgtttacccgtaaccccggtttaggtaaaccgggtttacccgtacccgtttaacgggtcccggtttacccgggaaccccgggttacccgggaacccggtaaccccggggttaaccccggttacccgtttaaccggttttaccttaaccggtttccgggttaccggttaccgggtaacggtttacccggttaacgggaaccgggttaaacgggaaccggtttaccggtactttaaaccgttacggttaccggttaccgggttcccgggttaaccgggg

SEQ ID NO: 145088 - DNA, 705 bp, Homo sapiens
  misc_feature: GYAE6OF02JAGHY.5.23.C01.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtncagctgcaggagtcgggacccaggactggtgaacgtccgttcggggacccctgtcccctcacctggcgtattgttctcggtgctccatcacgctactaatttaagttgggtacggtaccgtcggggtacccgccgtaaccggccccgaagggaaacgcggtaccgtgggaacggttagggtaggttagggggaacgtacgtacgttacgtaccgtaacggtaacccggggagacctaaacccgaaacctaacgtaacttccccggttaccctaacgaacgtacgttaccgaacgtaccctaacctagttaacctactagtaacgaacctacggtaaccgaaacctaaccgtactttccgtacccgtagtaacggtcctacctcgtacgtcgaccgccggacgacgtaaccggtccgttacgtataccgtggtcggcggtcggtaacttccgggaagggtacggaacgtacggtaaccttacgtaacgtcgttaccggacggtcggg

SEQ ID NO: 145089 - DNA, 480 bp, Homo sapiens
  misc_feature: GYAE6OF02G9XUK.5.23.C01.1.454.CMB.1.raw
  modified_base (458)..(480): a, c, t, g, unknown or other
  misc_feature (458)..(480): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtcgtggggcagacgggaccacggtcatcgtctcctcagcctccaccaagggcccatccggtccttccccccgtggccacccctcctcccgaacgacgccacctcgtcgggggaccacgacggcccggcccgtgggcctcggccgttgggtacaaacgggaccttaaccgttccccggtgttccttgacttctggacggcgggcgtgggacgacgggcgacagtacgnnnnnnnnnnnnnnnnnnnnnnn

SEQ ID NO: 145090 - DNA, 465 bp, Homo sapiens
  misc_feature: GYAE6OF02G0GF4.5.23.C01.1.454.CMB.1.raw
  modified_base (442)..(465): a, c, t, g, unknown or other
  misc_feature (442)..(465): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcaggagggaccacggtcatcgtctccgtcagcctccaccaagggcccagtccgtcttccccctggccacccctcctcccaacgacgccacctcgtcgggggcacgaggccggcccgtgggcctacgcccgtgggtcaaagggaccttacttccccggtgttcgtgtaactctaggacgcgggcgtgggacgaaggcgacatagnnnnnnnnnnnnnnnnnnnnnnnn

SEQ ID NO: 145091 - DNA, 658 bp, Homo sapiens
  misc_feature: GYAE6OF02H0H4E.5.23.C01.1.454.CMB.1.raw
  modified_base (98)..(98): a, c, t, g, unknown or other
  misc_feature (98)..(98): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (339)..(339): a, c, t, g, unknown or other
  misc_feature (339)..(339): n is a, c, g, or t
  modified_base (498)..(498): a, c, t, g, unknown or other
  misc_feature (498)..(498): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
tcagatcagacacgcacgaccggtgctcgatttagtacacgtgattagggattggggagatctatcataccgggagcaccaactacaatccgtccctnaagagtcgagtcaccatatctatagacacgtcgaacaaccagttctcccgtgaaggtcgacctctggcgaccgccgcggactaccgggtccgtactaattacctggtcgcgtaggtactttcgaagagggacaggtacttacgtatagtccgtaccgttgnggggtacaggacgggtaccaacgggttnagttcgcgtcgtcaacggcctccgacaacgggtccagtccgttctcccccgngacgaccctcctcccaagaccgtccaaccgttccgcgggtacctaccgacggcccggtcccgtggtccgacggtccgtacgggtactaacggaaccctcgttcccgtacgtcgtacgagttccgtagcggccgggtgttaccggacgacggggttaccncgtaaaccgttggaggntaccgggtnacgtcncgtcgacgtacgtcgtcgtacgcgtcgtacgcgacgacgacgacgacgcgtacgtacgtacgtcgtacgtcgtcgtcgtacgtcgtcgcgtctacgtcgtacgtacgtcgtacggtacgtcgtagtcg

SEQ ID NO: 145092 - DNA, 652 bp, Homo sapiens
  misc_feature: GYAE6OF02HXZX9.5.23.C01.1.454.CMB.1.raw
  modified_base (367)..(367): a, c, t, g, unknown or other
  misc_feature (367)..(367): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccagggtactgggtgaaggtcccgttccggggaccctcggtcccctcacctgcgattgtttctcgtcggcctcctatcacgtctaacttaattaagttgggtggtacccgttcggggtcccgacccgaccgccccccgaagggaaacggngggccgtagggtaggtgggtaggttggggagtatcgtatcacggtaccgggagacaaccaactacaactacccgtaccctacgaacgtacgtacgacgtacaccgatactctatacgacaccggtacaaaccaacgtacttacctaccgtagtaacgtcgtaccgtacttcgacgccgccggccggaacgaccggtccgtacttacgttacgtcggtcggccggtacggtactttacggaggtaacggacgacggtactacgttatacggtaccggtacgtcggg

SEQ ID NO: 145093 - DNA, 676 bp, Homo sapiens
  misc_feature: GYAE6OF02JATMF.5.23.C01.1.454.CMB.1.raw
  modified_base (345)..(345): a, c, t, g, unknown or other
  misc_feature (345)..(345): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcagggagtcgggcccaggtactggtagaagccgttccggggaccctgtcccctcaccgtgcgattcgtttcctcgtcggcctccatcagctactattaagttggtcggacctgggtcccgccgacgccccgaaggaaagngcgtggagtaggagttcggggatacgtactactacgacgtaccgggacgacgaacctaaaccgtaactaaccgtcccgtacccacgtaaacggtacggtacgtaacgtaccaactactaacgtacctaagtaacgaacgtacgtaccgaaaccaaacgtacgttaccctaccgtaaggtaaccggtcgtacccgtcgtacggtacgacccgaccggtaccggaaccgacccggtaccgttaactacgttaccgtggtcgtaccgggtacgttacgttcggaaggtacggaaccgtacggaacttactaaggtactaccggtacgtaccggg

SEQ ID NO: 145094 - DNA, 679 bp, Homo sapiens
  misc_feature: GYAE6OF02HX5PB.5.23.C01.1.454.CMB.1.raw
  modified_base (300)..(300): a, c, t, g, unknown or other
  misc_feature (300)..(300): n is a, c, g, or t
  modified_base (500)..(500): a, c, t, g, unknown or other
  misc_feature (500)..(500): n is a, c, g, or t
tcagatcagacacgcacgaccggtgctcgatttagtacacgtgattagggattgggcatgaccggtgctcgatttagtacacgtgattagggattggggatactttctgagactcatggacctcctgcacaagaacatgaaacacctgtggttcctcctcctcctggtggcagctcccagatcgggccctgtctcgaggtcgcagcgtgcgagggagtcgggcccaggacttggtagaacgtccgttcggggaccctgtccctcacctcgcgtattcgtttcgtcgtcggcctccactcngactacttaattaacgttggtacggtaccgttacgggtcccgaccaccgacccccgaagggaaacggacggacgtgggacggttaggtaaggttggggaacgtatacgttacgtacgtaggtacccgggagaacccgaaccaaactaacaactcccgtaccgtacaacggtagtacgtacgtacctaccattactactanaacgtaccaacgtaaccgaaactaaccgtacttacctaccgtacggtaacggtctacctacgtcgtaccgaccgccgacgaccgaccggtcctaccgttacttacgtcgtcggtcggtacggttagttacgacggtaaggacgtaacggtacttaacgtacgttacgtacgtaaccggg

SEQ ID NO: 145095 - DNA, 657 bp, Homo sapiens
  misc_feature: GYAE6OF02GCG2K.5.23.C01.1.454.CMB.1.raw
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctccagagtcgggccctgtctcaggtgcagctgcaggagtcggccaggactggtgaacgccgttcggggaccctgtccctcaccgtgcggtatcgtttcctcggtcgtccgtccagtcagccactagttaagttggtcggacgtcgggtccaccgacgccccgaaggaaacgacgcgtggagtggacgttggggaactntctatcgaacgtccggganccgacaaactacaactccgtacctacgaacgtagtaccgaagttccgaaccaagttactacgtaacgtagtaaccacgttaccgaaacaaccgtacgtttccacccgtagtaacggtcaccgttacgtcgtccgaaccggtccggacggtacccgaaccgtcccgtagttaccttacgtcgttcggacgtcgggttacccttacggacggtaacgggaacctcggtaaccttaccgtaagttacgttacccggtagttacccgggg

SEQ ID NO: 145096 - DNA, 868 bp, Homo sapiens
  misc_feature: GYAE6OF02IEC2G.5.23.C01.1.454.CMB.1.raw
tcagatcagacacgcacgaccggtgctcgatttagtacacgtgattagggattgggcacgaccggtgctcgatttagtacacgtgattaggattgggatactttctgagactcatggacctcctgcacaagaacatgaaacacctgtggttcctcctctcctggtgcagctcccagatggcctgtctcaggtgcagctgcaggagtcggccaggactggtagaagccgttcgggaccctggtccctacacccgtgcgtacttgtttccgtcgtacggacctcctaacgtccgtacgacctaactttaagttttaaacgtttcggggtacggtaacccgttcggggttcccgtaccccgtaaccgccccccggaaagggtaaacgggaccggtaaccgttgggtacggtacggggtagtttagggggaacgtaacttcgtaacgtccgtaacgttaaccgggacgtaaccgaaacccggtaaaccttaacgtaaaccgttccccggttaaccccgtacgtaaacggttaccgtacggtaaccggttacccgaaacccgtaagtttaaccttaccgttaaagttaccgaaacccgtaaccggtaaccgtaaaaccttaaacccgtaccgtttaccgttaccccgttaagggtaaaccggtcgttaacccgttacggttaccggtacccggtaaacccggttcccggaaccgggtaaacccgttaccgggtaccccgttaacgtttaacggtttaaccgtcgttacccggtaccgggtaaccggtttaacgttttaccgggaaaggtaaccgggttaacgaacggtttaacctaaccggttaactaccggttaaccggtcccgtaacgggg

SEQ ID NO: 145097 - DNA, 760 bp, Homo sapiens
  misc_feature: GYAE6OF02FQP2I.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagcctcccagagtgggccctgtctcgaggtgcagctgcagggagtccgggcccagggacgtggtgaacgtccgttccggggacccctcgtcccctcgaccgtgcgtattcgtttcgtcggtggcctccactcgagtaccattattaaggttggtcggtaccgtcgggtccgcccgaaccgccccgaaggaacggacggtcgtgggtacgtggtagtggggaatagtctagtacgtaacgtaccggggactacgaacccgtaacgtaaacaacccgttcccgtacccgtaacgtaacgacgggttaccgtaacgtccgtaaccctaagtttaacctcgtaaacgtacgaaaccctacggtaacccgaaactaaaccccgtacgttcccttaaccgtacggtaacggttaccgacccgttacgtcggttacccgcccgggtacccgtaccgggtaaccaccgggttcccgtaacgttacgttaccgttggtacccggtaccgggttcggttacggtttaaccggagggtaaccgggtaaccgtacggtaaaccgttacgttacgtaaccgttcgggtacccgttacggggg

SEQ ID NO: 145098 - DNA, 482 bp, Homo sapiens
  misc_feature: GYAE6OF02GYQMP.5.23.C01.1.454.CMB.1.raw
  modified_base (323)..(323): a, c, t, g, unknown or other
  misc_feature (323)..(323): n is a, c, g, or t
  modified_base (433)..(434): a, c, t, g, unknown or other
  misc_feature (433)..(434): n is a, c, g, or t
  modified_base (436)..(436): a, c, t, g, unknown or other
  misc_feature (436)..(436): n is a, c, g, or t
  modified_base (439)..(440): a, c, t, g, unknown or other
  misc_feature (439)..(440): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (449)..(450): a, c, t, g, unknown or other
  misc_feature (449)..(450): n is a, c, g, or t
  modified_base (453)..(482): a, c, t, g, unknown or other
  misc_feature (453)..(482): n is a, c, g, or t
tcagatcagacacgcacgaccggtgctcgatttagtacacgtgattagggattgggggagatctatcataccgggagcaccaactacaatccgtccctcaagagtcgagtcaccatatctatagacacgtcgaacaaccagttctccctgaaggtgacctctgtgacccgccgcggacacggccgtctattactgtgcgcggatttcagagggacaggactactatatcgacgtctggggcagagggaccacggtcatcgtctcctcagcctccaccaagggcccatcggtccttccccctggccaccctccctccaacggcncacctcgtgggggccacagccgcccgtgggctcgcctggtccaaggacctaccttcccggtacgtcgtgactcgtagagcgggacgtcggacgaagggcgacagtacgannanctnngcntantgnngtnnnnnnnnnnnnnnnnnnnnnnnnnnnnnn

SEQ ID NO: 145099 - DNA, 660 bp, Homo sapiens
  misc_feature: GYAE6OF02GX3SG.5.23.C01.1.454.CMB.1.raw
  modified_base (364)..(364): a, c, t, g, unknown or other
  misc_feature (364)..(364): n is a, c, g, or t
  modified_base (627)..(627): a, c, t, g, unknown or other
  misc_feature (627)..(627): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaacacctgtggttcctcctcctcctgtggcagctcccagatgggccctgtctcgaggtgcagctgcaggagtccgggccctaggactggtgaacgtccttcggggacccctgtccctcacctgcgtatgttctcgtggcctccatcagactactattaatggtcggaccgttgggtcccgccgacgcccccgtaggaacgacggtctaggagtggagttgggganatctatctagtaccggagcaccgactacgaactcccgtaccctacgaacgtacgtaccgtagtcccaaccgtacttacgttacctagttaacgaccgtaaccgtaccggaaacctaacccgtacgttcccttaaccccgtaggtaacggtcgtaacccgttccgtacgttacggaccccgtcggtacccggtaccacccgggttcccgtaaccgttagtttaccgtacgttcggcgtccggttactttacgaggaccgggtanacggtactactaacgtacgtaccgaggttccgg

SEQ ID NO: 145100 - DNA, 724 bp, Homo sapiens
  misc_feature: GYAE6OF02JUMUZ.5.23.C01.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtccncgtaggtcgcagctaggcgaggacgtccgggcccaggactggtacgaagcccgttccgggaccctcgtccctcaccgtcgcggtactcgtttcgtccgtggcctaccgtatccgagacgtacttattaaacggttgggtacggaccgttcggtacccgccgacccgaccccgaacggaaaaggcggtcgtagggtaggtacggtaggttcggggagtaacgtccgtaatccgtaacggtaaccggggactaccgaacccgtaaaccgtaaaccgtaacccgtaccccgttacccgtaacgaacggtacgtaccggtacgtaaccgtacctaacgtcttaaccgtaatacgacgtaacctacgaaacctaccgttactcccgtaccgtagacggtacgtaccgtctacgtcgaccgccgtaacggaccgtccgtcgtactaccgttactcggttcgaccgggtagttaccgtagtacgggaacgtaacacgggtaaccttacggtactacggttacggacgttaaccggg

SEQ ID NO: 145101 - DNA, 608 bp, Homo sapiens
  misc_feature: GYAE6OF02HJUKO.5.23.C01.1.454.CMB.1.raw
  modified_base (373)..(373): a, c, t, g, unknown or other
  misc_feature (373)..(373): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcgggaccctgtccctcacctgcgatgtttctcgtgctccatcagcactattaattggtggacctgggtccgccacgcccccaaggaagacggcgtggagtggaggttggggagagtcgtatcgtaagtaccgggtanaccaacctaacctaacaacgtcccgtaccctacgaacgtacgtacgacgtaccaccaatactcgtaatacgtaaccacggttaccgaaactaaccgtagtttcctaccctagtaacgtcgtacctctcgtacgacccgccgccggaaccaccggaccttctacgtttacgtgtacgcggtacgtagtttcgaaggtacggacgtacggtactacgtagtactcggtacgtccggg

SEQ ID NO: 145102 - DNA, 601 bp, Homo sapiens
  misc_feature: GYAE6OF02FMN9C.5.23.C01.1.454.CMB.1.raw
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcagggacgtccgggcccaggactggtagaacgccgttcggggaccctgtcccctcgacctgcgatcgtttctcgtggctccatcagcacttattaattcggtggaccgtgggtcccgccacgcccccgaggaaacgaggctggagtggattgggganactntatcagacggcgacacaactacaactccgtcctacaagcgtacgagtccaacctatacttctaactacgaacaccggtacgaaacctaactacgttcctaccctagtaaacggtctacctcgtagtcggaccgccgacgtacgaccggtcctactacgttaccgtggtcgacggtcggtactttacggacgtaagggaccgtagtaccttacgtacgtacgttacgccgtacggg

SEQ ID NO: 145103 - DNA, 795 bp, Homo sapiens
  misc_feature: GYAE6OF02H0756.5.23.C01.1.454.CMB.1.raw
  modified_base (145)..(145): a, c, t, g, unknown or other
  misc_feature (145)..(145): n is a, c, g, or t
  modified_base (176)..(176): a, c, t, g, unknown or other
  misc_feature (176)..(176): n is a, c, g, or t
tcagatcagacacgcacgaccggtgctcgatttagtacacgtgattagggattgggcacgaccggtgctcgatttagtacacgtgattagggattggggatactttctgagactcatcggacctcctgcacaagaacatgaaacncctgtggttcctcctcctctggtggcagccncccagagtcgggcctgtcctcgaggtgcagctcgacgagggacggtccgggacccgaggcgtgggtgaacgtcccggttccggggaccttccgtccctaccgtaccgtggaccgtatttcggtttccgttccggtcggtcctacccatcgactaccgtaacttaacgtttagttcgggtacggtaccggttcggggtaccccgaccgacccgaccccggaagggtaaacggcggtaccggtagggtacggtagggtacggttgggaagtcgtacgtacgtacgaacggtaccggacaccgaaccgtaacgtaacaaccgttcccgtacccaacggtaagtaccgtaacgtaccgtaaccgaacgtaacttacgtacgtaactaacgtacgtaccgtaaaccgaaacctaaccgttaccgttaaccgttacccgttagggtaaccgtaaccgtacttaccggttacgacccgccggtaacccgggaccgtaacgtccccggttactccgtttaacgttccggtaggtccggtcggttaacggttgttaacccggacgggtacgggtaaccgtaaggttcccgttaaacgttcggttaacccgtcgggtacgtacccgggg

SEQ ID NO: 145104 - DNA, 764 bp, Homo sapiens
  misc_feature: GYAE6OF02GMWDF.5.23.C01.1.454.CMB.1.raw
  modified_base (146)..(146): a, c, t, g, unknown or other
  misc_feature (146)..(146): n is a, c, g, or t
  modified_base (270)..(270): a, c, t, g, unknown or other
  misc_feature (270)..(270): n is a, c, g, or t
  modified_base (521)..(521): a, c, t, g, unknown or other
  misc_feature (521)..(521): n is a, c, g, or t
tcagatcagacacgcacgaccggtgctcgatttagtacacgtgattagggattgggcacgaccggtgctcgatttagtacacgtgattagggattggggatacttctgagactcatggacctctgcacaagaacatgaaacacctntggttcctctcctctggtggcctagcctcccagagtcgggccctggtctcgaggtcgcagtcgtgcaggaggtccgggccagggactgggtagaacgtccgttaccggggaccctcgtccccgnaccgtgtcgtattcgttcgtcgtggtcctcctagtcacgtactaaccttattaacgttaggtcggaaccggttcgggtaccgacccaccggtacccccgaagggaaacgtcgggcgttacggaggtacggtaggttaggggtacgtaacgtctaacgtcgtaaacggtacgggacgacccgtaaacaacccgtttaagaaccgtttcccgaaccgttacaaggtacgtacggaacgttacaccgtaacgtntaccgtaactaacgtacgtaccggtaaacggtaccaaacgtacgttaacccgttaccgtacgtaacggtaccggtaccttacgtacgttaccggaaccccgtaaccgggacccgtaccgggcccggtactttaacccggtattaacccggtcgttacggtacccggtaccggtacggtttaccaccgggtaacggtacgtacggaccgtttaactaaggtaccgtacggtcccgttaacgggg

SEQ ID NO: 145105 - DNA, 718 bp, Homo sapiens
  misc_feature: GYAE6OF02JNTCT.5.23.C01.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtnccagctgcaggngtcgggccaggacgtggtgaacgccttcgggaccctgtccctcacctgcgtactgtttctcgtggtacctccatctagactacgttaattaacttcgggtcggtaccgttcggggtccctccgaccgtaccccccgtaagggaaaacgaacgggtccgttacgggtaggttacggtaggttacggggagtaacttcgtacgttacacggtacgggactccgaaccctaacgtaccgtaaccgtcccgttacccgtacgaagtaccgtacgtaacgtccgaacccgtattacgtacttacgtagaacctacggtaccgtaacaaccgttacgttaccgttcccaggtaaaccgtcttaacccgtcgtacggttaccgaccctcccgggaaacggtcccgtaaccggtccgttaacgttaccgttacgtacgttacgccggttccggtatttccggaacggtacggtacgtacggtaacttacgtacctagtaccggtacgttaccggg

SEQ ID NO: 145106 - DNA, 760 bp, Homo sapiens
  misc_feature: GYAE6OF02IH0KH.5.23.C01.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
tcagatcagacacgcacgaccggtgctcgatttagtacacgtgattagggattgggcacgaccggtgctcgatttagtacacgtgattagggattggggatactttctgagactcatggacctctgcacaagacatgaaacacctgtcggttcctcctcctcctggtgcagctccagtatcgggcctgtctcgaggtcacngctgcgaggtacgtccgggaccaggtactggtacgaagtccggtaccgggcctcgtccctcnccgtggacgtacttggtttacctcggtacgccgtcacgtnacgctacttattaagttcggtacggacgtcgggttacccaccgtaccgaccccgaagggaacgcggtccgtagggtaggtacggtacggttaggggactagtactaagtcgtaacggtaccgaatacccgaacctacgtaacctacgtacccgtaccctaagaccggtacgtcgtacgtaaccctaacgtacttacgtccttaaagtaccgtaaccgtacccgtaacggtaacccttaaaccggtacctttacccgtaccggttaacggtaaccggttcaacccgtttccgacggtaacccggacccgcccggttacggaacccgttccgggtacccgttaacgttatacccggtttagggaccgttaccgggaggttttacccgttacggaaacccggttaggtaacccgttaggtaccttaaccggtagttaccgtacgggtaccgttaccgggg

SEQ ID NO: 145107 - DNA, 798 bp, Homo sapiens
  misc_feature: GYAE6OF02HLICQ.5.23.C01.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcgaggtncagctgcaggtacgtcgggcccaggtaccgtggtcgaacgtcccggttaccggggacccttcggtccctccgtaccgttcggccgtacgtttcggtttcccgtccggttacgggtcctacccgtacgttcgtaacggtaccttaactttaacgtttaaacgtttcggggtacggtaacccggttcggggttaccccgacccgaacccggtacccccccggaaagggaaaaccggtaacgggtccggtacgggtaacgggttagggtaaccgggtttggggaacgtaacgttaccgttaacgtacggtaaacggttaaccgggaacgacccgtaacccgtaaaacctaacctaaacccgttcccgtaccctacgaacggtacgtaccgaactaccgtaactacgttacaacgttacgtaacggacctaaccggtaccgaaaccgtaaccgttacgtttaccctaccgtacgtaacggtccgtaaccttcgttacgacgtacccgcggaccggacgaccggtctacgttacgtcgagtccggcgtcgtcgttacgaggtacggacgtacgtacctagtacgtacgtacgacgttaccggg

SEQ ID NO: 145108 - DNA, 459 bp, Homo sapiens
  misc_feature: GYAE6OF02HP03T.5.23.C01.1.454.CMB.1.raw
  modified_base (447)..(459): a, c, t, g, unknown or other
  misc_feature (447)..(459): n is a, c, g, or t
tcagatcagacacgcacgaccggtgctcgatttagtacacgtgattagggattgggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtcgtggggcaggagggaccacggtcatcgtctcctcagcctccaccaagggcccatcggtccttcccccgtggcccaccctcctccaagacgccaccgtccgtggggggccacgacgccgggccccgtgggccgtcgccgtggtcgaacgggacttaccttacccgtgttctgtactcgtggaggcgggtcgtgggcgaacgggcgacgagtagnnnnnnnnnnnnn

SEQ ID NO: 145109 - DNA, 788 bp, Homo sapiens
  misc_feature: GYAE6OF02IAMMG.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagcctccagagtcgggccctgtctcaggtgcagctgcgagggacgtccgggcccgaggtacgtgggtcgaacgtcccggttaccggggacccttccggtcccctccaccgtcggcgtacttcgtttccgtcggtcggtctccgatcacgtctacttaattaagttcgggtacggtccgttcggggtcccgccgaccggacccccgaagggaaacggacggcggtacgggtaggtcgggtaggtggggaacgtacgttacgtacgtaccgaacggtaccgggacgtaccgaaaccctaacgtaacctaaccgtcccgtacccgtacgtaacggtacgtacgtaaccgtaccgaaaccgtactaactacgttaacgtaacgtaacccgtaacggtaaaccgtaaaccctaaacccgttacggttaccgttaccccgtaaggtacggtaaccgtacccgttacgtacggttccggaccccgaccgggtacccggaaccgtcccggtaccgtactttaacgttacgtcggtacggtccggtaacggttaccgttacggaacgggttaccgggaaccgtacggaccttaacggttacgtaccggttaccgacggttaccggg

SEQ ID NO: 145110 - DNA, 765 bp, Homo sapiens
  misc_feature: GYAE6OF02G3VW7.5.23.C01.1.454.CMB.1.raw
tcagatcagacacgcacgaccggtgctcgatttagtacacgtgattaggggattgggcacgaccggtgctcgatttagtacacgtgattagggattggggatactttctgagactcatggacctcctgcacaagaacatgaaacacctgtggttcctcctcctcctggtggcagctcccgagagtcgggcccctgtctcgaggtcgcgagctgcgaggcgtccgggcccaggccgtggtacgaacgccgttacggggaccctcgtcccgtcacctgacgtacttcgtttccgtcggtcggtcctccgactcgacgacctaacttagtttaacgttcgggtcggtaccgtcgggtcccgcccgaccgacccccgtaagggaaacgacgggtcgtagggtacggttagggtaggttacggggagttacgtccgttaacgttaccggtaacgtaacccggggtacacccgaaaccgtaaaccgtaacctaaccgttaccccgtacccgtaccggaagtacgtaccggtacgttaccaaccgtaacgttactacgttaacgtaacgaacgtaaccggtaccgaaacctaaccgtacggttccctacccgtaggtaacggtcgtaaccgttcgtacgtaccggaccgccggtaccggtacccgaccggtacccgttacgtacgtttaccgtggttaccggtcggtacggtacgtttcggaaggtacgggtagaaccggtactaacgtattaccggtacgcccggttaggg

SEQ ID NO: 145111 - DNA, 694 bp, Homo sapiens
  misc_feature: GYAE6OF02HQQ3U.5.23.C01.1.454.CMB.1.raw
  modified_base (645)..(645): a, c, t, g, unknown or other
  misc_feature (645)..(645): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggtcctcctcctcctggtcggcagctcccgagagtcgggccctgtctcgaggtcgacagctggacagggagtccgggcccaaggacgtggtgaacggccgttacggggggaccccttcggtccccctactacccgtggaccgtagttcggttttccgtcggtcgggtacctcccgtaagtccaacggccaaacttaacgttaaagtttacggggtacggttacccggttacgggtcccccggacccgacccgaccccccggaaagggtaaaacgggacggtacggtacgggaggtgggtaaggttagggggagtacgtacgttaacgtcgtaacgtaccgggaacgtaccgaaaccaaacttacaaaccgtccgtacctcgaacgtgtacgagtacacgatagtactatagaacacgtacaaacaacgtacttacaccagtaacgtcgactcagtacgaccgccgacgacacggctacacttgcgtcgcgacggtnttcgaaggtacgagtaacggacctaacgtatacggtaccgaggtaccgg

SEQ ID NO: 145112 - DNA, 527 bp, Homo sapiens
  misc_feature: GYAE6OF02JGCG5.5.23.C01.1.454.CMB.1.raw
  modified_base (166)..(166): a, c, t, g, unknown or other
  misc_feature (166)..(166): n is a, c, g, or t
  modified_base (441)..(441): a, c, t, g, unknown or other
  misc_feature (441)..(441): n is a, c, g, or t
  modified_base (483)..(484): a, c, t, g, unknown or other
  misc_feature (483)..(484): n is a, c, g, or t
  modified_base (487)..(489): a, c, t, g, unknown or other
  misc_feature (487)..(489): n is a, c, g, or t
  modified_base (491)..(527): a, c, t, g, unknown or other
  misc_feature (491)..(527): n is a, c, g, or t
tcagatcagacacgcacgaccggtgctcgatttagtacacgtgattagggattggggagatctatcataccgggagcaccaactacaataccgtccctcaagagtacgagtcaccatatctatagacacgtcgaacaaccagttctccctgaaggtgacctctgtnaccggcccgcggacaccggccgtcgtacttactgtgcgcggatttcagagggacaggactactatatcgacgtctggggcagaggaccaggtacatcgtctcctcagcctccaccgtaacgggcccctagtccggtacccttccccccgttggccaccccgtccctaacccgaaggcaccctacccgtccggtcgggggaccacgacggccggcccgtggggtcctcggtccgtacggtcgaacggtacttaccgttacccggtggtctacggtntcgcggtacggcgggcgttcggacgcgggtcactagtacgcnnatnnngnnnnnnnnnnnnnnnnnnnnnnnnnnnnnnnnnnnnn

SEQ ID NO: 145113 - DNA, 826 bp, Homo sapiens
  misc_feature: GYAE6OF02IEZNH.5.23.C01.1.454.CMB.1.raw
  modified_base (218)..(218): a, c, t, g, unknown or other
  misc_feature (218)..(218): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctcctggtggcagcctcccgagagtcgggccctgtctcgcggtgcagctgcgagggngtccggccaggacgtggtagacgtccgtccggggaccctcgtccgtcacgtcgcgtagttcgtttcgtcggtcggtcctccaagtcgtacgtacctaacgttaagtttaacgttcggggtaccggtacccggttcggggtcccgacccgaacccgggtacccccgaagggaaaacggtacgggttcccggtagggtaaaccgggtggggtaacgggttagggggaataccgttaacgttaacggttaccgaaccgggttaaccgggaacggtaacccgaaaccgtaaaccgttaaacgtaaaccgttccccggtacccgttaaacgaaacgggttaccgggttaccggtaacccttaacgtaaacccgaactttacgtaaaccgttaacgtaaaccgtaaccggaacgttaacccggaaaactaacccgttactacccgttaccgtagtaccggtaacgtaccttcgtaggtacccgaccggtacccggaacggaccgaccggtccgtaccgttacgttagccggttcggtccggttacgtacgtttacggaccggtaaaggtcccgtaacgtacgtaacgttacgtacgttaccgggtagtaccggg

SEQ ID NO: 145114 - DNA, 790 bp, Homo sapiens
  misc_feature: GYAE6OF02FRNT0.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctcctggtggcagcctccagatcgggccctgtctcgaggtgcagctgacgagggacggtccgggacccgaggaccgtgggtacgaacggtcccggttccggggaccccttcgtccccgtccgacccgtcgcgtacgtttcggtttccgtccgtcggtcctccgtactccgacgtacctaactttaagtttaacgttggggtccggtaccggttccggggtacccgacccgacccggacccccgaaagggaaacggacgggtcgtacgggaggttcgggtaacgggttaggggaacgtacgtttaccgtacgtacggtaaccggtaaccggggacaacccgtaaacctaaacgtaaccgaaccgtttccccggtaccttaaccggaacgtacggtccgtaacgtacccaaccttattaaccgttaactacgttaaccgaccgtaacccgtaaccaaacccgttaaccgtacgttacccgtaccgtagtaccggtcgtaaccgtcgtacgccggtacccgcggaccggtaccgaccgtccgttactacgtcgttacggcgaccggttacgtaccgttacggcgaacggaccgttaggaccttaaccgtagtaccgtaccggtacgtacggg

SEQ ID NO: 145115 - DNA, 780 bp, Homo sapiens
  misc_feature: GYAE6OF02J0216.5.23.C01.1.454.CMB.1.raw
  modified_base (441)..(441): a, c, t, g, unknown or other
  misc_feature (441)..(441): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagctcccagagtcgggcctgtctcgaggtgcagcgtggcgagggacggtccgggccccagggaccgttgggtacgaacggtcccgttaccgggggacccttcggtcccctacacccgtgcgtacttcggttttcctccggtacgggccttccgtacgtaccgacggcctaacgttacgttttaaagttcgggtaggacccgttgggtcccgccgaccgacccccgaagggtaacggacggtcgagggtagtacggtaggttacggggtaanacgttacttacgacgtaacggtaacccggggacgtaccgaaccgtaaaccgtaaccgtaaccgttaccccgttacccgtaaccgaacgtacgtaccgtaacggtacctaaacctaactaactaccttacgtaacgaccgtaaccgtacgaaaccctaaccgttacttaccgtaccgtacgtaacggtccgtacctacggtacggtaccgacccggccggaccgtacgcccggtaccgttacgtacttaccggtcgaccggtcggacggttactacggtaacggtaaccggtacggtacgtaaccgtacgttaacgtacggtacggtccggttaacgggg

SEQ ID NO: 145116 - DNA, 890 bp, Homo sapiens
  misc_feature: GYAE6OF02FVVVD.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtcggttctcctcctcctggtggcagcctcccagatcgggcccttgtcctcgaggtgcagctgcaggagtccgggccaggactggtcggaagccgttcgggaccctgtccccctcacctgcgtattcgtttcgtcgtcggtcctccaattcgacgactacttaacttaagtttgggtcggtaccgttcgggtcccgacccgtacgaccccccgtaagggaaacgtacgggtacggtagggtacggttacgggtacgggttaggggacgtacgttacgtaactttacgaaaccgggtaccgggtacgtaccgaaacccgtaaaccgtaacctaaccgttccccgtacccgttaacgaaacggtacggtaaccggaacgtaccctaaccgtaacgttactaccgtttaaagtaaccgttaaccgtaaacccggttaacgaaaacccgtaaacccgtttacgtttacccccgttaaccgttaacgggttaaacccgggtttacggaccccgtttcggttaccggttacccggaccccggttacccgggaacccgggttaaacccgtaccgggttaccccggtttaaccgtttaaacgtttaaccccgggttcggaaaccgggtaccggggttaccgggtttaaaccgtttaccgggtaacggggaaccgggttaaccgtaaccgggttaaccgtttaaaccggttaaccttacggttaacccgggtaacccgggtttacccggggg

SEQ ID NO: 145117 - DNA, 750 bp, Homo sapiens
  misc_feature: GYAE6OF02HNET3.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacacctgtggttcctcctcctcctggtggcagctcccagatcgggccctgtctcaggtgcagctgacgaggagtccgggcccaggactggtcgaacggcccgttaccggggacccttgtcccctcaccgtgcgtattcgtttccgtcgtcggcctccatcgacgtctaccttaatttagttcggtcggtaccgttcgggtcccacccgaccgacccccgaaggaaacgcggcgtaggaggttcggaggttacggggagtacgttactagtacacggtaccgggacgacctaaccgaactacaaaccgtcccgtacccgtacaacggtacgtccggtaacgtaccctaacctaagtacttactaacgtaacgaccgtaaccgtaaccgaaaccgtaaacccgtacgttaccccgtaccgtagggttaacccgtaccggtaccgttacgtcggtaccggtaccccggccggtacccgggaacccgtaccgggtacccgttacgttaccgttccgtcggtacggtccggtacggttacgttaccgggtaaacggacgggtaccacgggttaccctaaccggttacgtacgttaccggtacggttaccgggg

SEQ ID NO: 145118 - DNA, 875 bp, Homo sapiens
  misc_feature: GYAE6OF02I8WDZ.5.23.C01.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtcggttcctcctcctccgtggtgcagcctcccagagtggccccttgtctacgnggtntcgagtacctgacgaacggtaggtaccgggcccaggtacgtacggtacgaacggtcccggttaccggggtacccctcgtccccgttacacccgttaggccgtaagttcgttttaccgttaccggtcggtacctaccgttaacgtcccgacgtaaccgtaacccgtttaaagtttaacggtttcgggtacggttaccgggttaccggggtaccgtcccggaaccgtaaccccggaacggtaaacggacgtcgtacggagttacggacggttgggaacgtagtacctagtacgacgttacggaacgaccaaagaacctaactacgacccgttactaccggtaaagtaccgacgtacgtaaccgtaactaaacttaacggaacttaacgtaacgtaaccctaaccggttaaaccgaacctaaacgtaccgtttaaccgtaaccgtaacggtaaccggttacgtacttacgtacgtacccggaaccgtccggtaaccgggaacccggtaaccggttaaaccccgttcttaaaacccggttcggtaacggtttaccgggacccggtaccggttttaaaacgttcccgggtaaaggttaaccggggaaacgttaagggaaacccttttaacccggtttaagtaaacggttacccgggttaaccggttaacccgggg

SEQ ID NO: 145119 - DNA, 803 bp, Homo sapiens
  misc_feature: GYAE6OF02JP0E4.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtgtcctcctctcctggtggtcagtcctcccagagtcgggcccgtgttccgtctacggtgccgacgcgtcgcgtaagggtacggtccgggacccgaccgggtaacgttcggtaggtaaacggtcccggtttacccggggtacccctcggttacccgtcccaaccttcggcgtacgttcgttccgttccggtcggtcctacctacgctacgtacattacgttacgttggtccggtccgtacggttcccgccgaacccggccccgtaacggaacggacggacgttcggaggttacggtacgttggggacgacgttcgaactttcgacgtaaccgggtcgaccgtaacccaacttaaccgacttcccgtacccgtactaacggaagtacgtacgtaccgtacctaacgtaactactaacgttaacgaacgaccggtactaaaccgtaacccgtaacgtttcccgccgttaacgtaccggtaactacccgtacgttccgtagtccccgggaccgtacccgggtaaccgaccggttccgtacgttaacccgttacgtacggttcggaccggtttaccgggactttaaccggtagggaccgggttaacggtaaccgttacggtaacgttaaccgttaacgttaccgggtaccgttaccgggg

SEQ ID NO: 145120 - DNA, 782 bp, Homo sapiens
  misc_feature: GYAE6OF02JNAIV.5.23.C01.1.454.CMB.1.raw
  modified_base (202)..(202): a, c, t, g, unknown or other
  misc_feature (202)..(202): n is a, c, g, or t
tcagatcagacacgcacgaccggtgctcgatttagtacacgtgattagggattgggcacgaccggtgctcgatttagtacacgtgattagggattgggggatactttctgagactcatggacctcctgcacaagaacatgaaacacctgtggttcctcctcctcctggtggcagctcccagagtcgggccctgtctcaggtncagcctgcaggcgtcggcccaggactggtgaacgtccgttacggggtacccctggtcccctcgtaccgtgcgtattggtttccgtcggtcggcctacctatcgacgtactaccttaatttaagttcgggtcggaccgttcgggtacccgcccgaccgtacccccgaagggaacggacggtcgtacgggacggtgggtaacgttcgggggagtactacgtaacgtcgtaaacggtaccgggacgaccgtaaccaacgtaccgaaccgttccccgtaacccgtacgaacggttacgtaccgtaacgtaccctaaccgtaattacgttacctacgtaacgaccgtaaccgtaaccgtaaccgaaaccgttacgttaacccgttcccgtaaggtaacgtccgtaacccttcggaccggttacccgcccgggtaaccggtaccgggtaacccgtacccgggttaccttacgtttaacgttacgtaccggtacggtacggtccgggtttaacttaacgggaacggtaaccgggtactaccgggtaaccttaaccgttaaggtaccgtaccggtacggttaccgggg

SEQ ID NO: 145121 - DNA, 1021 bp, Homo sapiens
  misc_feature: GYAE6OF02G8UTX.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaaccacctgtggttccctcctcctccgtggtggcagcctcccgagagtcgggccctgtctccgaggtcgacaggtctcgaccgagggacggtcccggggacccctaaggggtaccgttagggtacggaaaccggttccccggtttacccgggggtacccccttcggttacccccgtaccgtaccgtcggaccgttaacgtttccggttttccgtccggttccggtccttacccgtacttcgacggtaccctaactttaagtttaacgtttcgggggtacggtacccgttccggggtccccgacccgtaacccggaccccccggaaagggaaaccggtacgggacccggttaggggtaacgggtacggggttaacggggtttacggggggaattaaccggtttaccgtaaacgttaccggtaaaccggggttaaccccggggtaacgaacccctaaaacccgtaaaacccgttaaaccgtaacccgtttacccccggttaaaccccgtttaccgaaacgggttacccgggttaacccgggtaaccgggttaacccctaaacccgtaaacttttaacccgttaaccttaaacggtaaaccgtaacccggtaacccggttaaccgaaaacccgtaaaccgttcccgtttaccgtacccgttaacgggtaacgtaccgttaccgttaccggttacggttaccccggtacccgggccggtaacccgggtaacccgtaacccgggttcccggttaacgttttaccgttaaccgggttccggtaccgggtaccggttaccgggttacgtttaccggaaccggggtaaccgggttacggtaaccggtaacctttacgttaacgtaccgtaccggtaccggttaccgggg

SEQ ID NO: 145122 - DNA, 617 bp, Homo sapiens
  misc_feature: GYAE6OF02F7AYI.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcagggacgtcgggcccaggacgtggtgaacgccgttcggggaccctcgtccctcacctgcgatgtttctcgtcggctccatcagctactattaagttggtggaccgtgggtcccgccacggcccccgaaggaagcggcgtgggaggtgggagttggggagtagtgtatcgaacgtacgggacgacaaccgaaactaacaactcccgtaccctacgaacgacgtcgacgtccaacatactactataacgactacgtacgaacctaactacgttcctaccgtagaacggtcgtaccgtcgtcgtacgaccgccggcggacgaccggtacgtactacgttacgtgtcggccggtcggtacttacggagggtacggacgtacggtaacctacgttatacgtccggtaggttccggg

SEQ ID NO: 145123 - DNA, 797 bp, Homo sapiens
  misc_feature: GYAE6OF02GO55L.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtcggcagcctcccagagtcggccctgtctcgaggtcgcagctgacgaggacgtccgggtcccaggtactgggtcgaacgtccgttacgggaccctcgtccctacaccgtgcgtattcgttctcgtcggtcctccactcacgactacgttattaacgtggtcggaccgttcggtacccgaccgaccggaccccgaaggaaacggtcggtcgtagggtacggtaggtacggttacggggtactacgttacgtaactacgtaacggttaccgggaacgtaccgtaaaccgaaacgttaaccgaaccgttaccccggtacccaaccgtaaacggacggtaaccgtacgtaacctaacccgtaacgtaacgttacgtaaacgtaaccggaaccgtacccggtaaaccgtaaaccgtaaacccgttacgttaacccgttaccccgtaaggtaaccggtacccgtaacccgttcgttaaccggtaccggacccggaccggtaccgggaacccgtacccgggtaaccgttacgttaaccgttaccgttcggtaccggcggtaacggttaacgtttacggaacgggtaacggtaacccgtaggtaactaccttaacggtactaccgggtacgtaacggg

SEQ ID NO: 145124 - DNA, 847 bp, Homo sapiens
  misc_feature: GYAE6OF02HDBYC.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttccctcctcctccgtggtggcagctcccagatcgggccctgtctcaggtgcagctgccgaggacggtccgggcccgaggtacgtgggtacgaagtcccggttaccggggaccccttcggtacccctcgtacccgtggaccgtagtttcggtttccgtcggttcggaccttccggaacttccgaacgaccttaacgtttaagtttaaacggtttcgggttaccgggtaccggttcccggggttaccccgccgtaacccggacccccggaagggaaaacggacgggtcgtagggacggtacggtaggttggggaatacgttactaagtaccgaacgttaccggggaactaacctaacggaaaccttaaccgtaaccgttaccccgtaccctacggtaaacgtaccggtacctaaggtacccaaactacgtacttacgtaaacgttacgaacccgtacggtaacccgaaacgtaacctaccgttaccctccgtaacgtacggtccgtacgtacgtacggacccgtacccgggtaccggaacccgggtaacccgtaacccgggtccgtttaacgtacgtttaaccgtcggttaccgggaacccgggtcggttaacgtttaccgggaaacgggaaccggtttacgaacccgggtttactaaccggttaagttaaccgttaccggtaccggttaccggggg

SEQ ID NO: 145125 - DNA, 721 bp, Homo sapiens
  misc_feature: GYAE6OF02FPPAX.5.23.C01.1.454.CMB.1.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (355)..(355): a, c, t, g, unknown or other
  misc_feature (355)..(355): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtncagctgngaggngtccgggcccaggctggtgaagccttcgggggacccctgtcccctcgacctgcgtatcgtttctcgtggctccatcagcactattattggtgacctgggtccgccacgccccgaaggtaacgaggactggaggtgagtgggganatcgtatcgacgtaccgggagactaccaactactaacgtcccgtaccctactaacggagtaccgtagtacccaacctagtacttacgtaaacgtacgaacctaccgtaaccgaaaccaaacccgttaggttacccttcccgtacggtaaacggttccggaaccttaccgttacggttaccggacccggtaccccggaccgggtaacccgaaccgggtccccggtttaacgtaacgtttttaccgtccggtacgggtacccgggttaaccgggttaacttttacccggaaagggttaccggggtaagttaaccggtaccgtttaaaccttaccggttaaccgtacgggttaccccgggttaccgggg

SEQ ID NO: 145126 - DNA, 826 bp, Homo sapiens
  misc_feature: GYAE6OF02JANDC.5.23.C01.1.454.CMB.1.raw
  modified_base (189)..(189): a, c, t, g, unknown or other
  misc_feature (189)..(189): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctctctggtgcagctccagatgggccctgtcnaggtgcagctgcgaggacggtccgggcccgaggacgtgggtagaacgtcccggttcggggaccccttcgtacccctcgtacctggtccgtagtttcgttttccgtacggttcggtcctccgactccgtaagtcctaacttaagttttaaggttcgggtacggttaccggttcggggtacccgacccggtaacccgaccccggtaaagggtaacggacgggtcgttacgggaaggttcggggtaaggttagggggacgttaaccgttacgttagtacccggtaacggttaaccggggactaaccctaaacccgtaactaaccgttaaacccgttcccgtaacccaacggtaacgtaccggtaccgtacgtaacccaaaccgttaacttaaccgtacgttaaacgaacggtacgttaagtacccggtaacaaacccgtttaaccgttacccggtttcaaccccgggttggaaacggttcccgtaaccttacggtttccgggaaccgtccccggacccggtacgaacccggtacccggttcctttacgttacggttacgttccggtaaccggcgggttacctaacggttacgacgggtaacgtcgaacggttaccgttagtacgaccgtacgttaccggg

SEQ ID NO: 145127 - DNA, 817 bp, Homo sapiens
  misc_feature: GYAE6OF02FW0SN.5.23.C01.1.454.CMB.1.raw
  modified_base (519)..(519): a, c, t, g, unknown or other
  misc_feature (519)..(519): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagctcccagagtcgggccctgtctcgaggtcgcgacggctcggacgacgggacggtccgggacccgaggtacgtggtacggaacggtcccggttaccggggtaccccttcgtaccccgtccgtacccgtcggtaccggtactttcgttttccgttcggtccggtccttaccgtacgttcccgagtccgttaacgtttaagtttaacgtttcggggtacgggtaccggttccggggttcccgacccgtacccggacccccgtaaagggaaacggtacggtacgtaggggtacggtacggggtagggtacggggacgtacgtacgtacgtaccggtacggtaacccggganaccggtaaaccctaaaccgtaaccgtaaccgttcccgtacccgtaacggtaacgtacggtaccgtaacggtccaacgtactacgtacttacgaacgtaaccgaccgtaacgtaaacctaccgtacgttaccgtacgttacgtaacgggtaccgtacgttcgtacgtaccggtaccgccggtaccggtaccgtaccgtaccgttacgttaccgttcgttaggtaccggtcggtacgggttacgttcgaaccgggtacggtaaccgacggtactaccgtagtaccgtacgtcggtacggg

SEQ ID NO: 145128 - DNA, 831 bp, Homo sapiens
  misc_feature: GYAE6OF02JPUB8.5.23.C01.1.454.CMB.1.raw
  modified_base (108)..(108): a, c, t, g, unknown or other
  misc_feature (108)..(108): n is a, c, g, or t
  modified_base (522)..(522): a, c, t, g, unknown or other
  misc_feature (522)..(522): n is a, c, g, or t
  modified_base (768)..(768): a, c, t, g, unknown or other
  misc_feature (768)..(768): n is a, c, g, or t
tcagatcagacacgcacgaccggtgctcgatttagtacacgtgattagggattgggcacgaccggtgctcgatttagtacacgtgattagggattggggatacgtttnacgagactcatggtaacccttcctgcacgaaagtaaccagtacaaaccgaccttggtggttcccacctaccctcgtcgggtcgacctacggtcctcccgaggacgtcgggtaccccttgtctaccgaggtgaccagcctaggaccgtacgggtacgacccgggaccgacggttctagggtacgtaaccgtcccggttaccgggaaccctttggtacccccgactccgttacggtaccgttagttcggtttttaaccggccccggtaacgggttcccttacccggacgtaccgttaccggtacctaacctttaagtttaaccggttcgggtaggtacccccgtttggggtaccccacccggaacgtaccccggaaggaacggtaacggcgttagggacttggggtactggggtanccggtacacgttcgaccggggttaacggcgtaaccaacgaagttcccgaactttccccggaactaacgaacgtaccgtcggtaactacacctacgtactcggtaaatcggtaccgaacgtacctaaccgtaactccggttaatccgtaagaccggtactcctagtacggtccccgtacgtaccgggaccgttaccgaaccgtcgttttaacccgagttaccggcgaacccgggtttgaaaccggtnttaaacccggaggttaccggactaaccggtacttaagtacccgtcgacgttacccgtaagggg

SEQ ID NO: 145129 - DNA, 730 bp, Homo sapiens
  misc_feature: GYAE6OF02IESZ2.5.23.C01.1.454.CMB.1.raw
  modified_base (149)..(149): a, c, t, g, unknown or other
  misc_feature (149)..(149): n is a, c, g, or t
  modified_base (280)..(280): a, c, t, g, unknown or other
  misc_feature (280)..(280): n is a, c, g, or t
  modified_base (387)..(387): a, c, t, g, unknown or other
  misc_feature (387)..(387): n is a, c, g, or t
tcagatcagacacgcacgaccggtgctcgatttagtacacgtgattagggattgggcacgaccggtgctcgatttagtacacgtgattagggattggggatactttctgagacttcatggacctcctgcacaagaacatgaaacacctntggttcctcctcctcctggtggctacggctcccagactcgggccctcgtctctaacggtgcctagcctgccgagggacgtcgggccccaggcctaggtcgaacggcccttcggggacccctgtaccccgtnaccctggcgtacttggtttctccgtcggctccagtcagtcattactattagggctaccggcggttccgaccctacggacccccgaaggaaacgacggtcgtacgggnggttacgggaggttagggacggtaattcccgtaaagttccgaacgttaccggacgaacccgaactaaacctaccgtaactaccgtacccgtcgtaaacgccgttaccggaactaccgtacctaaacttgtacccgtaataaccggtacgaccgttaccgaaacgttaacccgtacgttaccgtaacccgtagtaacggttccgtacctcgtaaccggtcgacccgtacgaccgggttaaccaccggtccctcgtttacgtacgtctaacgtccggtaacggttcttacggacggttaccggaagttacgtacttacccgttagtacgtcccggtagttaccgg

SEQ ID NO: 145130 - DNA, 833 bp, Homo sapiens
  misc_feature: GYAE6OF02JDXOP.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtcggcagctcccagtagtcgggccctgtcctcgaggtcgcgacgctcgccgagggtacggtccgggacccgaggtaccgtgggtagaaccgtcccgttccggggacccttcgtccctccgaccgtcgcgtattcgttcgcgtcggtctacccgagtcacgctacttaagtttaacgttcggtacgggacccttcggggtcccctaccgacccggtacccccggaaagggtaaacggacggtcggtacgggtaggtacggggtaaggttacggggacgtacttcgtaacgttcgtaaccggtaaccggggactaccgtaaaccgtaaaccgtaaccgtaacgttaccccggtacccgtaactaaacggtccgtaaccggtaaccgtaccgtaaacttacgtaacgttacctaagtaaccgaacctaacccggtaaccgaaaccgtaaccgttacttaaccccgtcgaacggtacgtaaccgttacctccggttcgaaacccgggtcccacccggtaaccgggtaacccgtacccgggtaccgttaccgttaacgttacccgtggttacccgggtccggttaaccggttaacttccgggggtaaacgaccggggtaaacctacgggttaaccttaccgttaacggtcgttaacgggccgttacggggg

SEQ ID NO: 145131 - DNA, 816 bp, Homo sapiens
  misc_feature: GYAE6OF02JNWB0.5.23.C01.1.454.CMB.1.raw
  modified_base (201)..(201): a, c, t, g, unknown or other
  misc_feature (201)..(201): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttccctcctcctcctggtggcagctcccagatgggccctgtctcagggtncagctgcgaggcggtccgggccaggacgtggtagacgtccgttccgggaccctcgtccctcacctgcgtattcgttcgtcgtcggcctccatcacgactacgtattaagttcgggtcggaccgttcgggcccgccgtaccggacccccgaaggggaaacgacgggtcgtagggtacggttaggggtacggtaggggtacacgttctaagtccgaacgggtacccggggactacccgaaccgtaaactaaccgtaaccgttccccgtacccgtacggaaaggtcgtaccggtacggtaccaacccgtacttacgtacgtacgtaacggtaaccgtacccgtaaccggtaaaaccctaaacccgttacccgtttcccgtaacccgttaacgggtaaaccgggttcccggttaacccgtaccggtttaccggtacccggtaaccccgggaccccgggtaaccggggtacccggtaaccccgggtaccgttaccgtttaaccgtttaacccgtcgggttaacgccgggttaaccggttacgtttaccggaacgggtaacgggtaaccgtaacgggtaccttaaccggtacgttaacgtaccggtaccgggttaccgggg

SEQ ID NO: 145132 - DNA, 919 bp, Homo sapiens
  misc_feature: GYAE6OF02GUD5J.5.23.C01.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagctcccagagtggccctgtctcaggtncagctgcaggagtccgggaccaggactggtagaacgccgttccgggaccctcgtccctacgacctggacgtattcgtttcgtcgtcggacttccactactacgacctaacgttatttaaacgttcgggttacggtaccgttacggggttccccgacccgtaacccggtaccccccgtaaaggggtaaaaccggtacgggtaccggtttaacggggtaacgggtttacgggtaacgggttttagggggaaacgttaacgtttaccggttaaagtacccgtaaccggtttaacccggggaacgtaacctaaacccgtaaaccgttaaacgtaaacccgttaccccgtaaccccgtaacgtaaccgggtaaacgtttaccggtaaccggttaaaccgtaaaccgttaacgtaaacgtttaaccgttaaagttaaccggtaaacccggtaaacccgttaacccggtaaaaccgtaaacccgtttaaccggttttaccccgtaacccgttaacgggtaaaccgggttaccgttacccgttaaccggtttacggtaaccccggtaacccgggtacccggaaccgggttaacccgggtacccggttaacccggttacttaaccgtaccgttacggtaccggtaccggttaacgttacgttaaccgtacgggtaaacggttacgaaccggttactaaacgttacgtacccgtacggtaccggttacggg

SEQ ID NO: 145133 - DNA, 1151 bp, Homo sapiens
  misc_feature: GYAE6OF02GJKJW.5.23.C01.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacgtgattagggattgggcacgaccggtgctcgatttagtacacgtgattagggattggggatactttctgagactcatggacctctgcacaagaacatgaaacacctgtggttcctctcctcctggtgcagcctccgagatcgggccctgtctcgaggtcncagctgcgaggacgtcgggccaggtctgggtacgaacggtccgttaccggggacccttcgtccccgtacgaccgttcggaccgtagttcgttctccggtggtacctacctacgtcgacgcgtaacttaacgtttaacgttcgggttacgggtacccgttacggggtccccgacccgaacccgggtacccccgaaaggggtaaaccggtacgggtaccggttaccggggtaacggtacgggggtttaacggttagggggggtaacttaacggtttaaccggtaacggtttaacccggttaacgggttaaaccccgggggtaacgtaacccgttaaaaccccggttaaaccggtaaccgttaaaccccggtttacccccgggttaccccgttaaaaccggtaaaccggggtttacccgggtttaacccggtaaaccgggtttaaacccccgtaaccgggttaaaacctttaccgggttaaaccgtttaaccgggtaaaccggttaaacccggttaacccggttaaacccggtaaaccgttaaacccggttacggtttttaaaccccgttaccccgggttaaacgggttaaccgggtttaacccgttaaacccggttttacccggttaaccggggtttaccccgggtaaaccggggttaccccccgggttaacccggggtaaacccggggttaccccgggttaaacccggttttaaaccgtttttaaacccgggttaaccccggggttttaccggtttaccccggggtaacccgggggtttaacccgggttttaaccggtttttaacccggggtaaccgggggttaaacccgggggttttaaacccgaaaccccgggggggttttaaaacccttttaaacccggggttttaaacccggtttaccccgggggtttaaaaccccggggtttacccggttttaaacccccggggggg

SEQ ID NO: 145134 - DNA, 673 bp, Homo sapiens
  misc_feature: GYAE6OF02FJN48.5.23.C01.1.454.CMB.1.raw
  modified_base (583)..(583): a, c, t, g, unknown or other
  misc_feature (583)..(583): n is a, c, g, or t
  modified_base (615)..(615): a, c, t, g, unknown or other
  misc_feature (615)..(615): n is a, c, g, or t
tcagatcagacacgcacgaccggtgctcgatttagtacacgtgattagggattgggcacgaccggtgctcgattagtacacgtgattaggattggggatactttctgagactcatggacctcctgcacaagaacatgaaacacctgtggttcctcctcctcctggtcggcagcctcccagagtcgggtccctgttctcgtaggtcgtcagcgtggaccgagggacggtccgggaccccagggtacctggtacggacgtccgttacggggacccctgtccctcaccgtgacgtgtacgtttctcggtcggaccttcgacgtaccacgtacctacgttacgttaacgttcgggtcggtaccgttcgggttcccgacccgtaccggtacccccgaagggaaacggacggtcgtagggtaccggtaggtacggttggggactacgtcgtactacggaccgttacgggactacgaaccgtaacgtactaaaccgttcccggtaccttacgagtacgcgtaatccgactactactactagtacgacgacggctaacgctacgttacctcgagtacgtgacctgcgtacnccgacgtcggacctcgggtactcgtacgtacnggtactcggtacgtattcggaagtacgtcgacgtactaagtctacggtcgacgtcggg

SEQ ID NO: 145135 - DNA, 683 bp, Homo sapiens
  misc_feature: GYAE6OF02G1GFJ.5.23.C01.1.454.CMB.1.raw
  modified_base (210)..(210): a, c, t, g, unknown or other
  misc_feature (210)..(210): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggngtcgggccaggactggtgacgccgttcggggaccctgtccctcaccgtgcgattcgtttcgtcgtggctccatcacgcacttattagttggtcggtaccgtcgggtcccgccgaccggacccccgaagggaacgacggcgtgggaggtggaggttggggagtacgtcgtatacgaggtaccgggacgccaaacctaactaactaaccgttacccgtccctacgaacggtacggtaccgtacgtaccaacctaagttactactaactaacggacctaaccgtaccgaaacctaaccgttacgttaccgtacccgtagggtaacgtcggtacccttcgtacggtaccggacccgtccggaccggtaccggacccggtccggttaacttacgttaccgtcggttacgccgggtacgttacttacggacggaacggtacgacggtactacgtacgttacgtacggtaccggtacggg

SEQ ID NO: 145136 - DNA, 708 bp, Homo sapiens
  misc_feature: GYAE6OF02HIPEE.5.23.C01.1.454.CMB.1.raw
  modified_base (197)..(197): a, c, t, g, unknown or other
  misc_feature (197)..(197): n is a, c, g, or t
  modified_base (655)..(655): a, c, t, g, unknown or other
  misc_feature (655)..(655): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagctccagatgggccctgtctcaggtncgagctgcgaggacgtccgggcccaggactggtagaacgtccgttacggggaccctcggtccctcaccgtgcgtattcgtttctcggtcggtcctaccatcgagccgtactaagtttaagtcggtcggtaccgtcgggccgtacccgaccgcccccgtaaggaaaggaggtcgtagggtacggtaggtaaggttcgggagtacgttaccgtaatttccgaacgggttaaccggggactaacccgtaaaccgtaaaccgttaaacccgtaaaccgtttccccggtaaccccttaacggaaggtaaccggttaccggaacgtttacccaacccgtaattaccgtacgttaaagtacggtaaccgaaacccggttacaaaaccctaaccgttacgttccctaccgtagtacgtccgtactcgtacgcgaccgtacgccgtaccgacgtcctagtacgttancgtcgacgtcggattcgagtacggatacggtacttacgatcgacgtacgtcgg

SEQ ID NO: 145137 - DNA, 634 bp, Homo sapiens
  misc_feature: GYAE6OF02IT7S8.5.23.C01.1.454.CMB.1.raw
  modified_base (486)..(486): a, c, t, g, unknown or other
  misc_feature (486)..(486): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagcctcccagatgggccctgtctcgaggtgcagctgcaggagtcgggcccgaggacgtggtagaacgccgttccggggaccctcgtccctctacctgcgattcgtttctcggtcggcctccatcagacactaatttaagttgggtcggtaccgttcgggtccgacccgacggtaccccccgaagggaaacgacgggcgtagggacggtgggaggttcggggagtatcgtatacgaacggtacggacgaccaacaaacctaacgtaacctaccgtccctacgaacgacgtacgaagtccaacgaatactacgtaanacgacctaacgtacgaaactaaccgtattcctaccgtagtaacggtcaccgtcgtgacgacccgcgacgacaccggtcctactacgttacgagtcgacggtctacgttcgagagggtacaggtactactaactacgtaccgtgtacgg

SEQ ID NO: 145138 - DNA, 756 bp, Homo sapiens
  misc_feature: GYAE6OF02IAPPM.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtcggcagcctccagatcgggccctggtctcgaggtcgcagtctagcgaagggacgtccgggacccagggtacctgggtagaacgtccggttaccggggtaccttcgtaccctccgtacgtacgtcgtaactttcggttactccggtaggtcctaccgtacttacgaacgtacttaaccttaagtttaagttcgggtacggtaaccgttcgggtacccgaccgtaccggtaccccgaaagggtaacggcggtacgtcggggaaacgttgggtaacgggttacgggaactaccgttacgtaagttaccgaacggtaccgggactaaccaaaccgtacctaaccgtacgttacccgtcctaagaacggtacgtacgtacgtaccaacgtaactaacgttactaacgtacgaaccgtaacgtaacaaaccgtaaccgtacgttacgtaccgtaaggtaacgtacgtaccgttagacggtccaccggaccgacggtaaccgccgtacgtaccgttaagttcgtgaaccgtcgtcggttattacgaaccggtacggtactacggtacttacgtacgtacgtacgtcgtaaccggg

SEQ ID NO: 145139 - DNA, 799 bp, Homo sapiens
  misc_feature: GYAE6OF02JGQUD.5.23.C01.1.454.CMB.1.raw
  modified_base (314)..(314): a, c, t, g, unknown or other
  misc_feature (314)..(314): n is a, c, g, or t
tcagatcagacacgcacgaccggtgctcgatttagtacacgtgattagggattgggcacgaccggtgctcgatttagtacacgtgattagggattggggatactttctgagactcatggaccctcctgcacaagaacatgaaacacctgtgttcctcctcctcctggtgcagcctcccagagtcgggccctgtctcgaggtcgcagctgacgtagggacgtccgggcccaggtacgtgggtagaacggtccgttaccggggaccctcggtccctcgaccgtcgcgtacgttcgttcgtcggtcggtcctacctntacgagctacttaattaacgttgggtacggaccgttcgggtcccgacccgtaccggaccccgaagggaaaccggtaggtccggtagggacggttaggggtacggttaggggaacgtagtactacgtacgaacggttaccgggacgtacccgaaacctaacgtaacctaaccgttaccccgtaccgtaacgaacggtaccgtacgtaccgtaacctaactaacttacttaacgtacgtaacggaacgtaaccgtaaccgaaaccgtaacccgttacgttcccgttacccggttagtaaccggttaccgttaccgtacgtaccggtaccgacccggtccggtaccgggtaaccgttacccggtcccgttaacggttaccgtttacgtaccggttcgtcccgggtaaggttaccgttacggaacggtaaccggtaggtaacccggtacgttaaccgttacggtaccggttacggtaccggttaccggg

SEQ ID NO: 145140 - DNA, 801 bp, Homo sapiens
  misc_feature: GYAE6OF02HF6XO.5.23.C01.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaaacatgaaacacctgtggttcctcctcctcctggtggcagctccagatcgggccctgtctcaggtncagctgcgaggagtccgggccaggacgtggtcgaagtcccgttcggggaccctcgtccctcaccgtgcgtattgttcgtcgtcgctccatcacgctactatttaagttcggtcggaccgttcgggtccgcccgaccggacccccgaaggaaacggcgggcgtacgggaggtcgggtaggttagggagtaacgtctaagtcgaacgtaacgggacgaaccaacccgtaactaaccgtaaccttcccgtacccgtaaccgaaacggtacggtaccgtaacgtacccgaacctaattaacttaacctaacgttaacggaaccgtaaccgtaacccgtaaacccgtaaacccgttaccgttacccgttaaccgtaacggtaacggttaaccgaccgtttaccggttacggtacccgggtaccccggacccgggtaaccgggtaacccggaacccgggtcccggtttaacgtttaccgtttaccggttacggtaccggttaccgggtacccgggttaggtttaacccggaaagggtaccggggtaacgtaaccggggttaaccttaacggttaccgttaacggttaccggtaccggtttaccgggg

SEQ ID NO: 145141 - DNA, 928 bp, Homo sapiens
  misc_feature: GYAE6OF02HCLBS.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcgaggtgcgagctgcgaggagtccgggcccaggacgtggtgaacgtcccgttccggggaccctcggtccctcgtaccgtcgcgtacttcggtttcgtccggtggtccttaccgacttccgacggacctaacttaagttttaagtttggggtacggtaacccgttcggggttaccccggacccggtaccggtacccccccggaaaggggtaaaacggacgggtaccgttaggggtaacgggttacggggtaacgggtttacgggggaacgttaacgtttaccgttaacggtaccgtaacgttaaaccccgggggaagtaccccgtaaaacctaaaacccgtaacgtaaacccgttaccccggttaccccgtaacgtaaacggtacggttaaccggtacggtaccctaaaccgttaaacgtttacgttaaccgttaaagttaaccggtaaacccgtaaaccgttaacccgtaaaaccgtaaaacccgttacggttttaaccccgtaaccgtttacgggaaaccggtttaccgtaacccgtttccgttacgggttaccggaccccgggtacccgtaccgggaaccgtacccggggtacccgtttaaccgttaaccgtttaccggtcggttaccgggccggttaccggttaacgtttccgggtaaacgggtacgggaaccgttacgggtaaccctttaaaccgttacgttaccggttaccggtaccggttaaccgggg

SEQ ID NO: 145142 - DNA, 748 bp, Homo sapiens
  misc_feature: GYAE6OF02J21I5.5.23.C01.1.454.CMB.1.raw
  modified_base (145)..(145): a, c, t, g, unknown or other
  misc_feature (145)..(145): n is a, c, g, or t
  modified_base (171)..(171): a, c, t, g, unknown or other
  misc_feature (171)..(171): n is a, c, g, or t
  modified_base (215)..(215): a, c, t, g, unknown or other
  misc_feature (215)..(215): n is a, c, g, or t
  modified_base (284)..(284): a, c, t, g, unknown or other
  misc_feature (284)..(284): n is a, c, g, or t
  modified_base (595)..(595): a, c, t, g, unknown or other
  misc_feature (595)..(595): n is a, c, g, or t
  modified_base (604)..(604): a, c, t, g, unknown or other
  misc_feature (604)..(604): n is a, c, g, or t
  modified_base (658)..(658): a, c, t, g, unknown or other
  misc_feature (658)..(658): n is a, c, g, or t
  modified_base (701)..(701): a, c, t, g, unknown or other
  misc_feature (701)..(701): n is a, c, g, or t
  modified_base (714)..(714): a, c, t, g, unknown or other
  misc_feature (714)..(714): n is a, c, g, or t
tcagatcagacacgcacgaccggtgctcgatttagtacacgtgattagggattgggcacgaccggtgctcgatttagtacacgtgattagggattggggatacgtttctgagactcatggacctcctgcacaagaacatgaaacncctgtacggttcctcctcctcctggnggacagcctaccagtacgtcgggtccctgtactcgagggtcacngctggcgaggacggtccggaccctaggtactggtacgtaaccgcccggtttacgggaccctggtccccnctaccgttgctacgttgttccgtcgtacggcctaccagtcacgtaccttattacgttacggttcgacggtaccgtccgggaccctaccgaccggacccctaaaggggtaaaccgtcggtacggtacggtacgggtacggttacggtacgggtaaactcgtaccttaaccggcgtaaccgtaaccggacaaccgtaaccgtaacgtacacccgttcccgtaccaacgtacgtagtacccgtagacctaacgataccgtaagtaagaccgtaacctacgaaccgtaacacttacggtaaccctgacggtaacnccgttaacncggtagaccccgtacgacgtaccgaccgacctttccgagttacctaaccgggtntcccggacggttaaccggttgtaaaccggacgaacccggggtnaaacccgggttanaacccgttgttacccgggagttccggtaaacggg

SEQ ID NO: 145143 - DNA, 432 bp, Homo sapiens
  misc_feature: GYAE6OF02F1XCQ.5.23.C01.1.454.CMB.1.raw
  modified_base (414)..(432): a, c, t, g, unknown or other
  misc_feature (414)..(432): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttcccccctggccacccctcctccaagacgccacctcgtgggggcacagcggccctgggctgcctggtcaaggactacgttcccgtgtctgactctgacgcggcgtggcgaaggcgcagtagcnnnnnnnnnnnnnnnnnnn

SEQ ID NO: 145144 - DNA, 569 bp, Homo sapiens
  misc_feature: GYAE6OF02FYU8D.5.23.C01.1.454.CMB.1.raw
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactaatatcgacgtctggggacagagggaccacggtcagtcgtctccgtcacgcctccaccaacggcccatccggttactcccccgtggccaccctcctccaagacgcaccctcgtggggcacgagccggccgtgggctgcctggacaaggactactccgtgtctggactactgacgcggacttggcgaaggtcgacagtaggctgtacntagacatgagnacgagtcacngaaccttaanacgtacgacgtagtactacgtacgacgacgtacgtacgtacgtacgacgacgtacgtacgtacgtacgtaacgtacgtacgtacggtaactacgtacgtacgacgtacg

SEQ ID NO: 145145 - DNA, 1002 bp, Homo sapiens
  misc_feature: GYAE6OF02G25ZJ.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaaagaacatagaaacacctgtcggttccctcctcctcctggtggcagctccagtatcgggtcctgtctcgaggtgcgacgcgtggccgaagggtacgggtccgggacccgtagggtaccgttgggtcggtaaaccggtcccggtttaccgggggaccccgttccggttaccccgtcctaccgtcggtcgtagtttcgtttccggtccggtcgggtcccttaccgtactaccgtaggaccttaactttaacgtttttaacgggttacgggttccgggttaacccgggtttccggggggtacccccgtacccccggtaacccgggtaaccccccgggaaaggggaaaacgggtaccgggtacgggtacggggtaacgggttacgggggtaacgggggtttacgggggtatttaaccggtacgttaacgtaccggtaaacggtaaaccgggaccgtaacctaaaacccgttaaacgtaacccggtaaacccgttacccccgggtaacgttaaccgtaacgggtttaaccggccggttaacccggttaccctaaacctaacgtttaacgttaaacccttaaagggtaaccgtaaaccgtaaacccggttaacccaaaccgtaaaccgttcccgtttacccgtaaccggttaacggttaaccgggttaggttaccccgttagggtaccggttaacccggggacccgtacccggtaccgggaacccgtttaaccgggtacccgttaaacgttttaccgttaccggtacggtttaaccggtaccgggtttacggttaccgtttaaccgggaacggggttaacccgaacgggttacgttacctaaaggtttccctaaccgggttacggtccggttacggg

SEQ ID NO: 145146 - DNA, 869 bp, Homo sapiens
  misc_feature: GYAE6OF02HMZ8L.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatagaaacaccgtgtggttcctctcctctggtgcagctcccagatcgggccctgtactcgaggtgaccagtctgactaggacgtcgggccctaggacgtggtagaacgtccgttcggggaccctgtaccctcaccgtgcgactgttctcgtcggctaccgatcagtcaaccttaagttaatttacgggtacgggtaaccgttcggggttacccgacccgaaccgtaccccccggtaaggaaaacgggtacggtacggtacgggtaaggtagggtaacggtttagggggagtacgtacgttagtaccgtaacggttaaccgggaacggacctaacccgtaaacgtaaaccgtaaaccgttacccggttaccccttaacgaaacggtaacggtccggtaacgttacccgaaacccgttaacggttaaactaccgttaaacgttaaacggtaacccgtaaacggtttaaaccgaaaaccgttaaaacccgttaaccgtttaacccgtacccgttaacggtaaaacgggttaccgtaacccttacgttaaccggttacggaaaccccggtacccgggtaaccggtacccgtaaaccggggtaccccgttaaccggttaacgtttaccgttacgggtaccggttcccgggaaccggttaccgttttacgaaggtaaccgggtaaccgtaacggtaaccgttaacgttaacttaacggtaccgtaccggttaaccgggg

SEQ ID NO: 145147 - DNA, 780 bp, Homo sapiens
  misc_feature: GYAE6OF02JKF1B.5.23.C01.1.454.CMB.1.raw
  modified_base (203)..(203): a, c, t, g, unknown or other
  misc_feature (203)..(203): n is a, c, g, or t
  modified_base (278)..(278): a, c, t, g, unknown or other
  misc_feature (278)..(278): n is a, c, g, or t
tcagatcagacacgcacgaccggtgctcgatttagtacacgtgattagggattgggcacgaccagtgctcgatttagtacacgtgattagggattggggatactttctgagactcatggacctccgtgcacaagaacatgaaacactgtggttcctcctcctcctggtggacagcctcccagagtcgggccctgtctcaggtncacgcgtgacgagggtacgtccgggaccagggactagggtgtaacgcccggttaccgggaccctcggttaccccncgtaccgttcgggacgtactttcgttaccgtcgtcggtccgtcccaagttccacgtccgtaacgttaaacgttaacggtttcggtaggttacccgtccggggttcccgacccggaccggtaaccccccggtaaggaaaaacgggtccggtacgtagggacggtttagggaaggttcgggggacttacgtaccgttaagtaccgaacggttaacccggggactaccgtaaaccgtacctaaacctacggtacccccgtccggtacgtaacggacgttccggaacgttaccgacccgtattacgtacgacttaaccgacctaccggttaaccgaaaccgttacctacgttacctccgtaagtaccggttacgaccgttacgtccggtacgtcccggccgttaacgacccgacgtccgtactagttcccgttagcccggtgtaccgtagtaccgaacggtacggacgtacggtaaccgtactacggttacggtaccgttaaccgg

SEQ ID NO: 145148 - DNA, 487 bp, Homo sapiens
  misc_feature: GYAE6OF02IG02W.5.23.C01.1.454.CMB.1.raw
  modified_base (199)..(199): a, c, t, g, unknown or other
  misc_feature (199)..(199): n is a, c, g, or t
  modified_base (455)..(487): a, c, t, g, unknown or other
  misc_feature (455)..(487): n is a, c, g, or t
tcagatcagacacgcacgaccggtgctcgatttagtacacgtgattagggattggggagatctatcataccgggagcaccaactacaatccgtcccctcaagagtcgagtcaccatatctatagacacgtcgaacaaccagttctccctgaaggtgacctctgtgaccgccgcggacacggccgtctattactgtgcgnggtatttcgagagggacaggactactatatcgacgtcgtggggacgaggacgggaccacggtcacgtcgtcctcctcacgccctccaccgaacgggcccagtccggttccttacccccgtggcccacccctcctaccaggacgccaccgtcggtcggggcacggcgaccggccgtggcctcggccgtggtacgaacggcttaccgtccgtgtctgtactcgtcggcggtcgggcgtcggacgacggcgctagtgcnnnnnnnnnnnnnnnnnnnnnnnnnnnnnnnnn

SEQ ID NO: 145149 - DNA, 818 bp, Homo sapiens
  misc_feature: GYAE6OF02IZS3I.5.23.C01.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagacatgaaacacctgtgttcctcctcctcctggtggcacgctcccagagtcgggccctgtcncgaggtcgcacgctgacgaggacggtccggaccaggacgtggtagaacggtcccggttaccgggaccccttcgtcccctactacccgtggtaccgttactttcggtttacccggtcggtaccggtccttacccgacgtccgtaacggtaccttaaacgtttaaggtttttaacggtttcgggggttaccggtacccgggttccggggtaccccgtaccccggaacccggtaacccccggaaaggggaaaccggacgggtaccggtagggttacggtacggggtaggttacggggatacgttacgtacggtaccgtaccggtaaccgggactaacccgaactaaacgtaaccgtaaccgtcccgtaacccgtacgaacggtaccgtacgtaccgtaacctaaccgtactaacgttacctaaagtaaccgaccgtaaaccgtaccaaaccgttaacttccgtaacccgttccgtaaacggtaccgtacgtacccgttagttcgtaccggaccggtaccggaccgtacgccggtcttaactcgttcgtcgtacggtccgtacgtacggttgaacgggtcgaaccgtaggtaaccttaccgttagtacccggtacggtaccgtcgggg

SEQ ID NO: 145150 - DNA, 908 bp, Homo sapiens
  misc_feature: GYAE6OF02JT4QV.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctctcctggtggcagctcccagatcgggccctgtctcgaggtcgacacgtccgtgccgagggtacggtccgggacccctagggtacgtggtacgaaacgtcccgttaccggggaccccttcggtcccctctaccgttggccgtagtttcgtttcgtcggtcgtcctccgatcgagcctacttaagttacgttcggtcggtaccgtcgggtaccctccgaccgaccccgaagggtaaaggtcggccgtaggtaggttacgggtacgttggggactacgttacgttacgccgtaacggtaacccggggactaacccgtaacccgtaaacctaacgtaaccgttcccccggttaacccgtaccgtaaacgggtaccggttaccggtaactacccgaacctacgttaacttaaccgtaacgttaaacggaacccgtaaccggtaacccgtaaaccgtaaacccgttcgttacccgttaaccccggtaggtaaaccgggttaccgtaacccgttccgttaacggtacccgggtaaacccccgtcccgggtaaacccggtaacccggaaccccggggttacccgtttaaccgtttacgtttaacccgggttcggtacccggggttccggttaaaccggggtttacctttaacggggaacccgggttaaacggggtaacccgttaaccgggggtttaacccttaaacccgggttaaccgggttaacggttaccccgggttaaccgggtttcccggggg

SEQ ID NO: 145151 - DNA, 1064 bp, Homo sapiens
  misc_feature: GYAE6OF02HJUTE.5.23.C01.1.454.CMB.1.raw
tcagatcagacacgcacgaccggtgctcgatttagtacacgtgattagggattgggcacgaccggtgctcgatttagtacacgtgattagggattggggatactttctgagactcatggacctcctgcacaagacatgaaacacctgtggttcctcctcctcctggtgcagctcccgagagtcgggccctgtctcgaggtgcagctgcgaggagtccgggccgaggacgtggtacgaacgtccggttcgggaccctcgtcccgtcaccgtcgcgtacgttcgtttcgtcggtacggtcctccataccgagtacctaacttaagtttaacgttcggggtcggtaacccggttcggggtaccccgacccgaaccggtacccccggaagggaaacggacgggtaccggtagggtacggtacgggtaacggttgggggaatacgttacgtagttaccggaacggtaaccgggtacgtaccaaacccgtaaaccgtaaccgttaaaccgtaccccgttacccgtaaccgtaaacggtaccgggttaccgtaaccggttacccaaacccgttaaagttaaacccgttacgtttaaaacgtaaccggtaaacccgttaaacccgggttaaacccgtaaaaccccgttaaacccgttaacccgggttttaaccccctttaaccccggggtaaacgggttaaaccgggtttacccggtaaacccccggttttacgggtttaaccccgggttaaccgggaaaccccccgggttaaccccgggggtaacccgggtaacccccgggtttaaaccccgggggttacccccgttttaaaccgggttttaacccttttaaaccccggggtccggggttttacccggggttaaccccggggttaacccggggtttttaacccgtttttaacccgggggtaaaaccggggtttaaacccggggggaaaccccggtttaaaaccgggggttaaaccccctttttaaaccggggtttaaaacccggttttaaacccgggttttacccccgggggtttaaaacccgggtttcccccgggggggg

SEQ ID NO: 145152 - DNA, 539 bp, Homo sapiens
  misc_feature: GYAE6OF02HK41S.5.23.C01.1.454.CMB.1.raw
  modified_base (153)..(153): a, c, t, g, unknown or other
  misc_feature (153)..(153): n is a, c, g, or t
  modified_base (237)..(237): a, c, t, g, unknown or other
  misc_feature (237)..(237): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (467)..(469): a, c, t, g, unknown or other
  misc_feature (467)..(469): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
  modified_base (488)..(490): a, c, t, g, unknown or other
  misc_feature (488)..(490): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagatcagacacgcacgaccggtgctcgatttagtacacgtgattagggattggggagatctatcataccgggagcaccaactacaatccgtccctcaagagtcgagtcaccatatctatagacacgtcgaacaaccagttcctcctgaggngacctctgtgaccgccgcggacacggccgtctattacgtgtgcgacggtatttcgagaggacagactactatatcgacgttcgngggacaggaacggccacggtcgactcgttctccacgcgcctccgaccgacggcctacgtcggtcccttaccccgcgaccctccctccctaccgaacgcacctaccgtcgtccgggacaccgacgcccgtccgcggtcgtcgccgtggacacgactaccttccgtgtactgacgtctaggacgcgggtacgtcgacggtacgcgacgttagaccgtgacgcagnacgncgnnngcgngngncgncgcgctcnnncgcngacgncnactcgntactctcacactactcacgacgtacgtntatn

SEQ ID NO: 145153 - DNA, 709 bp, Homo sapiens
  misc_feature: GYAE6OF02F61IA.5.23.C01.1.454.CMB.1.raw
  modified_base (199)..(199): a, c, t, g, unknown or other
  misc_feature (199)..(199): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtgcagcctcccagatgggccctgtctcaggtncagctgcaggagtccgggcccaggactggtcgaagccgttcgggaccctgtccctcacctgcgatgttctcgtgctccntcancactattatggtgtccgtcggtccgccacgcccccgaaggaacgacggcgtagggacgtagggagttggggagagtcctagtcaacggtaccgggagaccaaccaactaacaacgttccccgtaccctaccgaacgtacgtaccgtactacgaacccgtattacctactaacgtacgtaacccacgtaccgaaccaacccgtacgtttccctacccgttacgaaccggttaccgtacccgtaccgttacggtaccggaccccggaccggtaccggaccgtaacccgggcccgtttaccgttacgtttacccttcgggtccggtaccggggttcggttaaccgtttaccggtaacgggtaccgggtaaccgtaccggtaaccgttaaaccttacggtttaacgtacccgggtacggtttaacccgggg

SEQ ID NO: 145154 - DNA, 890 bp, Homo sapiens
  misc_feature: GYAE6OF02FQKRN.5.23.C01.1.454.CMB.1.raw
  modified_base (299)..(299): a, c, t, g, unknown or other
  misc_feature (299)..(299): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtcggttcctcctcctcctggtggcagcctcccagagtcgggccctgtctccgaggtgcagctcgcgagggacggtccgggaccaggactggtacgacggccgttaccggggacccttcgtacccctcaccgtgccgtattgtttccgtcgnggtcctcctagtcgacgccgtacttaagttagtttcgggacggtaccgttccggggtccgcccgaaccgacccccgaaggggtaaacgcgggaccgtttgggtaacggtcggggttaaggttacgggggtacgtaacgtttaccgttagaaccggtaaccggttaccggggtacggaacccgtaaaccctaaaacgtaacccgtaaacccgtttacccccgggtaccccgttaccgaaaacgggttacggtttacccggaacgtttacccaaccccgttaaacgtttactaccgttaaacgttaaaccgaaccgtaacccgggtaaaccgaaaaccgttaaaacccctccggtttacccctaacccgggtacggtaaacgggttcctaaccccggttgtaaccgggttcccggaccccggcccggtacccgggtaaacccgtcccggggtacccgttacctttaaaggtttacccgaggttccgggaaccggttccgggttaacgtttaccggaacgggtaccgggaaaacggaccgggttaacccttaacggttacgttaacccggttcgggtaacccggtttccggggg

SEQ ID NO: 145155 - DNA, 747 bp, Homo sapiens
  misc_feature: GYAE6OF02IAMZM.5.23.C01.1.454.CMB.1.raw
  modified_base (546)..(546): a, c, t, g, unknown or other
  misc_feature (546)..(546): n is a, c, g, or t
tcagatcagacacgcacgaccggtgctcgatttagtacacgtgattagggattgggcacgaccggtgctcgatttagtacacgtgattagggattgggggatactttctgagactcatcggacctcctgcacaaagaacatagaaacaccttggtggttccctcctcctccgtggtggcagcctccagatcgggccctgtctcgaggtcgcagctacgcgagggtacggtccgggacccagggtacgtgggtacgaacgtcccgggttaccgggacccttacgtcccgtaccgtacctggtacgtacgttacgtttccgtcggtcggtacctacctacgtacaacgtacgtacttaagttacggtcggtacggtaccgtcgggtacccgaccgtaacgaccccgaagggaaacggtacggtacgtagggtaggtacggacgggtacgggagtagtaccggtacttacgaacggtaaccggacgtaccaaaccgtaaccgtactaaccgtcccgtacgtacgaagtcgtacggactacccgaactanactacgtatacgtaccacgtacaaactacgtacttacgacgtacgtacgtaccgtaccttacgacggtcgaccgaccggaccgaacgccggtactaccgtttagtcccgtaggtaccggtacggtacggttaaccttacggacgggtaacgaccggtagttaaccggttaataaccggttacgtacccggtaggtaccggg

SEQ ID NO: 145156 - DNA, 698 bp, Homo sapiens
  misc_feature: GYAE6OF02HW9CS.5.23.C01.1.454.CMB.1.raw
  modified_base (116)..(116): a, c, t, g, unknown or other
  misc_feature (116)..(116): n is a, c, g, or t
  modified_base (537)..(537): a, c, t, g, unknown or other
  misc_feature (537)..(537): n is a, c, g, or t
tcagatcagacacgcacgaccggtgctcgatttagtacacgtgattagggattgggcacgaccggtgctcgatttagtacacgtgagttagggattggggatactttctgagactnatggacctcctgcacaagaacatagaaacctacctgtggttccctcctcctccgtggtggcagcctcccagatcgggccctgtctcgaggtgctagctggcgaggcgtcgggacctaaggcgttggacaacggtccgttacgggcctccgtcctcaccgtgccgtagttcgtttcgtcgtcggtcctcgaacgtccgagtactaactttagtttaacgttcgggttacggtaccgttccgggtccaccgtacccggaccccgaagggtaaacgcgggtcgttagggtaggtacggtacgggttacggggaatagttcgtaacgtacgtacggttaacccgggataacggaaccctaaactacgaaaccttccccgtaccgtaacgacgtaacgtccgaactaccactagttatacgttaanacggacaacgtaacaactaaccgtacgttacctaccgtaggtactaccgtactacggtcgacccggtaccgcccggaggtacccgccggtaactccgtaacgtcgtacgtcgcggagttacctggaaccgtgtcgaatccgattacgcgtagtcgtacggg

SEQ ID NO: 145157 - DNA, 742 bp, Homo sapiens
  misc_feature: GYAE6OF02IRNFO.5.23.C01.1.454.CMB.1.raw
  modified_base (733)..(733): a, c, t, g, unknown or other
  misc_feature (733)..(733): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcagctcccagatcgggccctgtctcaggtgcagctgcgaggacgtccgggcccaggtacgtggtaggaaggtcccgttccggggacccttcgtccctccaccgtgacgtcttgtttcctcggttggtcctaccgactaccgacggtacctaacttaatttaaacgttgggggtccggtaacccggttcggggttccccgacccgtaccgaccccccggtaaagggaaaacggtcgggtaccggtgggtaacggttagggtaaggggtttcgggggaatacgttacgttaaacgccgtaaccggtaaccggggaacgtacccgaaaccctaaacgtaacccgtaaacgtcccccgttacccgtaacgaacggtacggtccgaacgtaccacctaattactacgtaatacgacctaaccgtacaaaccaccgttactcccgtactacgtacggtctaccgtgtcgtaccgacccgtccggccgaccgccggtcctacgttacgtcttggcggtcggttcgcttacggaggtaacgacggtacgtaactacgtacgtattaccggngtaccgggg

SEQ ID NO: 145158 - DNA, 755 bp, Homo sapiens
  misc_feature: GYAE6OF02JIAIG.5.23.C01.1.454.CMB.1.raw
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacagaacatgaacactgtgttcctcctcctcctggtgcagctccagagtcggccctgtctacgtaggtcgcacgcgttcgaccgaggtacgccgggtacccaggtacgtggtacgaacgtccgttccgggaccctccgtcccgtcacctgcgattcgttcncgtgcctccatcganctactattaacgttggtcgtaccgtcggtccgccaccgaccccgaaggaacgtacgggcgtaggtacggtgggtacggtcggggagtactcgtaacttaccgacggtaaccgggtacgaccgaaccctaaacgtaaccgtaaaccgtcccgttacccctaacgaacggtacgtaccgtaacgtacccaacgtaactttacgtaacctagtaaccggactaaccggtaaccaaaccgtaccttacgttacccggtaccgtaacgggacgtacctcgtacgtttcggacccgtaacccggtccgggtaacccgaaccggtaccggtacccggtttacttactttacccgggtgtaaccggcggttaaccggttacgttaacggaaccggggacgtaaccggacctttaaccggttacttaacggttacccggtccggttaaccggttccgggg

SEQ ID NO: 145159 - DNA, 802 bp, Homo sapiens
  misc_feature: GYAE6OF02JZDYU.5.23.C01.1.454.CMB.1.raw
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
tcagatcagacacgcacgaccggtgctcgatttagtacacgtgattagggattgggcacgaccggtgctcgatttagtacacgtgattagggattggggatactttctgagactcatggacctcctgcacaagaacatgaaacacctgtggttcctcctcctcctggtggcacgcctcccaggactcgggccctgtctcgaggtgcacgctcgganacggngtcgggcccaggtactggtagacgcccggttcggggaccctcgtccccgtcaccgtgccgtagttcgttcgtcggtcggcctaccgactcgacgactaacgttattaacgttgggacggtaccgttcgggtacccgccgaccggacccccggtaaagggaaacggacgggttcgggtaacgggagggttacgggggtaaacggttaggggggtaacgtacgttacggttaacgtccgtaaaccgggttaccggggaaccgtaacctaaaccctaaacgtaaacctaccgttaccccggttaacccgtacgaaacggtacggtaccgtaacgtaccgaaccgttagtaacttactagtaacggaaccgtaacgtaaccgaaaccgtaaccgtaacgtttacccgaccgtaacgggtaacggtacctaccgttgtaccgtaccggtaacccgcccggaaccggtacctaaccggtccgttaacgttaacgttcgtaccgtacggtcccggtaacggttaccttacgggaaggaacgtaacggtacggtaacgaaccttaggtaaccgtcggtaccggtacggg

SEQ ID NO: 145160 - DNA, 498 bp, Homo sapiens
  misc_feature: GYAE6OF01CGJ6U.21.4.A04.1.454.CMB.1.raw
  modified_base (309)..(309): a, c, t, g, unknown or other
  misc_feature (309)..(309): n is a, c, g, or t
  modified_base (494)..(494): a, c, t, g, unknown or other
  misc_feature (494)..(494): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccanagggccactggcatcccagacaggttcagtggcagtgggtctgggacagacttcactctcatcattagcagactggagcctagaagtatttcgctagtgtattactgtcagcagtatggtaagttcacctctgtcgttcggccgaagggaccaaggtagaatagaaacgactgtaggctagcacntctg

SEQ ID NO: 145161 - DNA, 498 bp, Homo sapiens
  misc_feature: GYAE6OF01CUW50.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctntcctgcagctccagccagaatatccagagctactacatagcctggtaccagcagaagcctggccaggctccaggttcctcatctatgctcgggtcccacagggccactggcatcccagacaggttcagtgcagtggtctgggacagacttcgactctcatcattagcagactggagcctagaagtatttcgctagtgtattactgtcagcagtatggattcactctgtcgttcgcaagggaccaaggtacgaataggaaacgtacgtgtagctagacactagtcgttacg

SEQ ID NO: 145162 - DNA, 538 bp, Homo sapiens
  misc_feature: GYAE6OF01CE30T.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctactacatagcctggtaccagcagaagcctggccaggcctcccaggttccctcatcctatcgctcgggtcccacgacgggcccacgtggcactcccagacaggttcaggtcggcaggtgggtctggggacagacttcactctcatcattagcagactggacgcgtagaagtatttcgactagtgttattactgtacagtcagtagtggtaagttcacgttctgtccgttcggccgaagggacctaagggtaagaaagtaggaaacgacgtggtacggtctagaccgactgtcgttcg

SEQ ID NO: 145163 - DNA, 503 bp, Homo sapiens
  misc_feature: GYAE6OF01A408I.21.4.A04.1.454.CMB.1.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (498)..(498): a, c, t, g, unknown or other
  misc_feature (498)..(498): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggcctcccaggttccncatctatgctgggtcccacgngggccactggcatcccagacaggttcagtggcaggtgggtctgggacagacttcactctcatcattagcagactggagccgtagaagtatttcgctagtgtattactgtcagcagtagtggtaagttcacttctgtcgttcggaccagggacctaaggtagaagtgaaacgatgacgtcagacacntctcg

SEQ ID NO: 145164 - DNA, 503 bp, Homo sapiens
  misc_feature: GYAE6OF01AWMKC.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcgactctcatcattagcagactggagcctgaagatttcgcagtgtattactgtcagcagtatggtaagttcactctagtcgttcggccaagggaccaaggtagaaatagaaacgaacgtagaggctagacacctatcgtcg

SEQ ID NO: 145165 - DNA, 499 bp, Homo sapiens
  misc_feature: GYAE6OF01A9P0B.21.4.A04.1.454.CMB.1.raw
  modified_base (200)..(200): a, c, t, g, unknown or other
  misc_feature (200)..(200): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccanagggccactggcatcccagacaggttcagtggcagtggtctgggacagacttcactctcatcattagcagactggagcctagaagatttcgctagtgtattactgtcagcagtatggtaagttcaccttctgtcgttcggccaagggaccaaggtagaaatggaaacgacgtgtaggctagacacatctg

SEQ ID NO: 145166 - DNA, 490 bp, Homo sapiens
  misc_feature: GYAE6OF01DKB4F.21.4.A04.1.454.CMB.1.raw
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacngacttcactctcatcattagcagactggagcctagaagtatttcgctagtccgttattactgtcagcagtatggtaattcactctgtcgttcggcaggacaaggtagaatagaaacgatgngctgcacntntcg

SEQ ID NO: 145167 - DNA, 501 bp, Homo sapiens
  misc_feature: GYAE6OF01CUQQX.21.4.A04.1.454.CMB.1.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
  modified_base (494)..(494): a, c, t, g, unknown or other
  misc_feature (494)..(494): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctccaggttcctcatctatgctgggtcccanagggccactggcatcccagacaggttcagtggcaggtgggtctgggacagacttcactctcatcattagcagactggacgctagaagatttcgctagtgtattactgtcagcagtatggtaagttcacttctgtcgttcgacaaggaccaaggtagaaatggaaacgacgtagtacgtctagacacngtctacg

SEQ ID NO: 145168 - DNA, 492 bp, Homo sapiens
  misc_feature: GYAE6OF01CZUUZ.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (464)..(464): a, c, t, g, unknown or other
  misc_feature (464)..(464): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctcgggtcccagacgggccacgtggcatcccagacaggttcagtggcaggtggtctgggacngacttcactcncatcattagcagactggagcctagaagtatttcgactagtgtattactgtcagctagtatggtattcacttctgtcgttcgcaggacaaggtanaagtagaacgatgngctganacntctcg

SEQ ID NO: 145169 - DNA, 495 bp, Homo sapiens
  misc_feature: GYAE6OF01CYV5I.21.4.A04.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctccaggttcctcatctatgctgggtcccanagggccactggcatcccagaccaggttcagtggcagtgggtctgggacagacttcactctcatcattagcagactggagcctagaagatttcgctagtgtattactgtcagcagtatggaagttcactctgtcgttcggccaagggaccaaggtagaaatagaaacgaagtgtgctagcacatctcg

SEQ ID NO: 145170 - DNA, 489 bp, Homo sapiens
  misc_feature: GYAE6OF01AQOF8.21.4.A04.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
  modified_base (486)..(486): a, c, t, g, unknown or other
  misc_feature (486)..(486): n is a, c, g, or t
tcagtcgtcgctcgcacgaccggtgctcgatttagagtagtgatcaggggagagctgctcagttaggacccagagggaaccatggaaaccacagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccanagggccactggcatcccagacaggttcagtgcagtggtctgggacagacttcactctcatcattagcagactggagcctagaagtatttcgctagtgtattctgtcagcagtatggattcactctgtcgtcgaccgaaggaccgaaggtagaaagtgaaacgtatgtagctagcacgntcg

SEQ ID NO: 145171 - DNA, 510 bp, Homo sapiens
  misc_feature: GYAE6OF01BK3CP.21.4.A04.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (502)..(502): a, c, t, g, unknown or other
  misc_feature (502)..(502): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccacctctcctgcagctccagccagaatatccagagctactacatagcctggtaccagcagaagcctggccaggcctcccgaggttccncatctatgctgggtcccagacgggccacgtggcatcccagacaggttcaggtgcagtgggtctgggacagcttcactctcatcattagcagactggagcctagaagtatttcgctagtgtattactgtctagctagtagtggtaagttcactcgtgtcgttcggacgtaacggactaaggtagaatcggaaacgactggtacgctacgacacngtcgtacg

SEQ ID NO: 145172 - DNA, 562 bp, Homo sapiens
  misc_feature: GYAE6OF01EV194.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagcctccagccagaatatccagagctactacatagcctggtaccagcagaagcctggccaggcctcccaggttcctcatctatcgctcgggtcccacgacgggccacgtggcactcccagacaggttcagtggcaggtgggtctgggacagacttcactctcatcattagcagactggagccgtagaagtatttcgacgtagttgttattacgtgtcagtctaagtagtagggtaattccgtaccttcgtacgttccggttcggaccgtaaacgggtaaccgtaaagggtaacgtaaaagtacggaaaacgtaacgtaggtacggtactacgacaacctgtcgtacg

SEQ ID NO: 145173 - DNA, 486 bp, Homo sapiens
  misc_feature: GYAE6OF01AICLO.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (482)..(482): a, c, t, g, unknown or other
  misc_feature (482)..(482): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanatccaccctctcctgcagctccagccagaatatccagagctactacatagcctggtaccagcagaagcctggccaggctcccaggttccncatcatgctgggtcccanagggccactggcatcccagacaggttcagtggcagtggtctgggacagacttcactctcatcattagcagactggagcctgaagatttcgcagtgtattactgtcagcagtatggtaagttcactctgtcgttcgccaaggaccaaggtagaatgaaacgactgtgctgacacntctg

SEQ ID NO: 145174 - DNA, 507 bp, Homo sapiens
  misc_feature: GYAE6OF01B0PIU.21.4.A04.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (354)..(354): a, c, t, g, unknown or other
  misc_feature (354)..(354): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangcccacctctcctgcagctccagccagaatanccaganctactacatagcctggtaccagcagaagcctggccaggctcccaggttccctcatctatcgctgggtcccacagggccacgtggcatcccagacaggttcagtggcaggtgggtcngggacagactttcactctacatcattagcagactggagcctagaagtatttcgcagtgtattactgtcagtcagtatagtaagttcacgttctgtcgtggaccaagggaccaaggtagaatagaaacgagtgtaggctagactacatcgtacg

SEQ ID NO: 145175 - DNA, 542 bp, Homo sapiens
  misc_feature: GYAE6OF01CC4V9.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccagacgggccactggcatcccagacaggttcagtgcagtgggtctgggacagacttcactctcatcattagcagactggagcctagaagtatttcgctagtgtatttactgtcagctaagttagtagggtaagttcaccttcgttcgttccggttcggaccgaaagggaaccgtaaagggtaacgaaagtacggaaaacgtaacgtaggtacggtactacgaccacctagtcgtacg

SEQ ID NO: 145176 - DNA, 499 bp, Homo sapiens
  misc_feature: GYAE6OF01EIQOH.21.4.A04.1.454.CMB.1.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
  modified_base (493)..(493): a, c, t, g, unknown or other
  misc_feature (493)..(493): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctccaggttcctcatctatgctgggtcccanagggccactggcatcccagacaggtcagtggcagtgggtctgggacagacttcactctcatcattagcagactggagcctgaagatttcgctagtgtattactgtcagcagtatggtaattcactctgtcgttcggccgaagggaccaaggtagaagtagaaacgacgtgtacggtctagacactntcgtcg

SEQ ID NO: 145177 - DNA, 720 bp, Homo sapiens
  misc_feature: GYAE6OF01CEHRY.21.4.A04.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgtgacgcagtctccaggcaccctgtcttgctccgaggggaaancgccaccctctcctgcagctccagccaagaatanccagagctactacatacgcctaggtaccagcaagaagcctgggccaggcctacccgaggttccctacatctatcggccgttcggggacccacgacggggcccacgtcgggaccaacgtccccgaaggtaccgtaagggtttccaaagggttcgggaccgtaagggttcggggtaccgtagggggaacctaacggtaccctttacaaccgttcctactaacgtacctaagtttaacggaccgtaaggtaaccgttaggggaaccgtaccgtaagggtaaagttacgttttccggacgttaaggttacgttaactttacgtggtaccaaggtcgtaagtacgtacgggtaacgttccaaccgttgtccggttaccggttaccgggaacccgaaaacggggtaacccaaaaggggttaacgaaaagttacggaaaaacccggtaacgttgggtacggtacctacggaccctaaccgtagttccgttaccgg

SEQ ID NO: 145178 - DNA, 651 bp, Homo sapiens
  misc_feature: GYAE6OF01CMZJ7.21.4.A04.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagagtagtgatcagggagagctggctcagttaggacccagaggaaccatggaaaccccaagcgccaggcttctcttcctcctgctactctggctcccaggcctcgacggtaaacccaccggtagaaattggtgttgaccgcagtctccgaggccaccctgtctttgctccgaggggaaangccaccctctccgtgcagctaccagccagaactatccagacgcctactacagtacgcctggtaccagcctagaacgcctggccaggtccttcccgtagggttccctcgaacttccgtactggctcggggtcccagacgggccacgtgggacatccccagacctaggttcaggtgcaggtggtcctgggacagtacttcgtactcgtcatctaattacgcctagaccgtaggaacgtccctaaggaactactttccgactaaggtcgttaagttacgtggtacaggtcctaaggtagtagggtaacgtttccaaccgttcgtacggttcccggttaccggaccgtaaaacggggtaccctaaaagggttacgaaaaggttcggaaaaacccggtagttcgggcggtaccttacggaccctaaccgtagttccgttaccg

SEQ ID NO: 145179 - DNA, 491 bp, Homo sapiens
  misc_feature: GYAE6OF01AYJYZ.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcggaaaccaccggagaaattgtgttgacgcagtctccaggcaccctgtctttgtctccaggggaaantccaccctctcctgcagctccagccagaatatccagagctactacatagcctggtaccagcagaagcctggccaggctcccaggttccncatctatgctgggtcccanagggccactggcatcccagacaggttcagtgcaggtgggtctgggacagacttcactcncatcattagcagactggagcctagaagtatttcgctagtgtattactgtcagcagtatggaattcactctgtcgtcgcgaaggaccaaggtagaatgaaacgtactgtagctgacacatctgtc

SEQ ID NO: 145180 - DNA, 520 bp, Homo sapiens
  misc_feature: GYAE6OF01B572U.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttcctcatctatgctgggtcccagagggccacgtggcatcccagacaggttcagtggcaggtgggtctgggacagacttcactctcatcattagcagactggagcctgaagtatttcgctagtgtattactgtcagctagtataggtaagttcacttcgtcgtcggttcggaccgaacgggaccgaaggtacgaaataggaaacgtacgtggtcggtctgaccacctagtcgtcg

SEQ ID NO: 145181 - DNA, 543 bp, Homo sapiens
  misc_feature: GYAE6OF01AY2XQ.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaaangccaccctntcctgcagctccagccaagaatatccagagctactacatagcctggtaccagcagaagcctggccaggctcccaggttcctcatctatgctcgggtcccagagggccagtcggccatcccagacaggttcagtggcaggtgggctgggacagacttcactctcatcattagcagactgganctagaacgtntttcgctagtgtattacgtgtcagtcagtagtggtaacttcacttctgtccggttacggaccgtaaagggaaccgtaaagggtaacgtaaagtaggtaaaaccgtacgtaggtacggtactacggacctacctagttccgttacg

SEQ ID NO: 145182 - DNA, 530 bp, Homo sapiens
  misc_feature: GYAE6OF01CC73U.21.4.A04.1.454.CMB.1.raw
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (456)..(456): a, c, t, g, unknown or other
  misc_feature (456)..(456): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
  modified_base (523)..(523): a, c, t, g, unknown or other
  misc_feature (523)..(523): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtcccnccaggctccgagggaagggctgggagtgggtcggccgtattacaaggaaagctaaacagttacagtacagaatacggcncgtcngtagaaaggaggttcaccatctacaagagatgaattcaaagaactcactgtatctagacaaatgaacngacctagaaaccgagacacggccgtgtattatgtggtanaacaaagngtaggatggtggtaggtagngtgtacg

SEQ ID NO: 145183 - DNA, 541 bp, Homo sapiens
  misc_feature: GYAE6OF01CEGOJ.21.4.A04.1.454.CMB.1.raw
  modified_base (200)..(200): a, c, t, g, unknown or other
  misc_feature (200)..(200): n is a, c, g, or t
  modified_base (361)..(361): a, c, t, g, unknown or other
  misc_feature (361)..(361): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggtcctcatctatgctgggtcccacacgggccactggcactccccagaccgaggttcagtggcaggtgggtctgggacngacttcactctcatctatacgcagactggagcctagaagtattcgcagtgtattactgtacagcagtagtaggtaacgttcaccgttctcggtcgttcggaccgaagggtaaccgtaagggtaagaaagtaacggaaaccgtaaacgttcggtaggccttagaccaacctgttcgttacg

SEQ ID NO: 145184 - DNA, 523 bp, Homo sapiens
  misc_feature: GYAE6OF01ELU1N.21.4.A04.1.454.CMB.1.raw
  modified_base (198)..(198): a, c, t, g, unknown or other
  misc_feature (198)..(198): n is a, c, g, or t
  modified_base (516)..(516): a, c, t, g, unknown or other
  misc_feature (516)..(516): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaaangccacctctcctgcagctccagccagaatatccagagctactacatagcctggtaccagcagaagcctggccaggcctcccaggttcctcatctatgctcgggtcccagagggcccacgtggcatcccagacaggttcagtggcaggtgggtctgggacagacttcacttctcatcattagcagacgtggagtcctaggaagtagtttcgctagttgttattactgtcagctaagtagtaggtaagttcacctcgtcgtcgttcggaccaagggacctaaggtagaaatagaaaacgacgtagtacggctagacactntcgtacg

SEQ ID NO: 145185 - DNA, 486 bp, Homo sapiens
  misc_feature: GYAE6OF01EX1EU.21.4.A04.1.454.CMB.1.raw
  modified_base (201)..(201): a, c, t, g, unknown or other
  misc_feature (201)..(201): n is a, c, g, or t
  modified_base (456)..(456): a, c, t, g, unknown or other
  misc_feature (456)..(456): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgctagtgtattactgtcagcagtatggattcactctgtcgtcgcaaggacaaggtanaaatgaaacgactgtggctgacacatctcg

SEQ ID NO: 145186 - DNA, 513 bp, Homo sapiens
  misc_feature: GYAE6OF01BL0YP.21.4.A04.1.454.CMB.1.raw
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
  modified_base (497)..(497): a, c, t, g, unknown or other
  misc_feature (497)..(497): n is a, c, g, or t
  modified_base (507)..(507): a, c, t, g, unknown or other
  misc_feature (507)..(507): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacgacgggcccacgtggccactcccagacaggttcagtggcaggtgggtctgggacagacttcactctcatcattagcagactggacgcctagaagtactttcgcgtagttgtattactgtacngtctaagtataggtaagttcaccttntgtcgtcggcaacgggacaaggtagaatagaaacgactgngtcagacacntcgtcg

SEQ ID NO: 145187 - DNA, 490 bp, Homo sapiens
  misc_feature: GYAE6OF01AUMAW.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (486)..(486): a, c, t, g, unknown or other
  misc_feature (486)..(486): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatatccagagctactacatagcctggtaccagcagaagcctggccaggctcccaggttcctcatctatgctgggtcccacgagggccacgtggcatcccagcaggttcagtggcagtgggtctgggacagacttcactctcatcattagcagactggagcctagaagtgtttcgctagtgtattactgtcagcagtatggtattcactctgtcgttcggcaagggaccaaggtgaaatgaaacgatgtagctgacacntctg

SEQ ID NO: 145188 - DNA, 613 bp, Homo sapiens
  misc_feature: GYAE6OF01AQW27.21.4.A04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaangccaccctctcctgcagcctccagccagaatactccagagctactacatacgcctggtaccagcagaagcctggccaggcctcccgaggttccnatctagtcgcgtcgggtcccacgacgggcccacgtggccacgtccccaaggtaccgtaggttccagggtcggacgtagggtcggggtctggggaactacggtacctttcacttctacactctattagcagtacgtggacgtccgtaggtaacgtacgtttcgactagttgttacttacgtgtacagtacgtagttagtaggtacgttcctaccttcgttcggttccggttcggaccgtaaacgggtaccgtaaagggtaacgaaagtacggaaacgtaacgtaggtacggtacgtacgacctaaccgtagttcgttacg

SEQ ID NO: 145189 - DNA, 547 bp, Homo sapiens
  misc_feature: GYAE6OF01D1R8O.21.4.A04.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (417)..(417): a, c, t, g, unknown or other
  misc_feature (417)..(417): n is a, c, g, or t
  modified_base (463)..(463): a, c, t, g, unknown or other
  misc_feature (463)..(463): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatacgcctggtaccagcagaagcctggccaggctcccaggttccncatctatgctcgggtcccacgacgggccacgtggcactcccagacaggttcagtcggcaggtgggtctgggacagacttcacgtctcatctattagctagacgtaggagtcctagaagtatttcgntagtagtattacgtgtacagctagttataggtaacgttcaccgttntcgtcgtacggaccgaagggtacctaaagggtaagaaagtacggaaacgtacgtaggtcggtactacgaccacgtatcgttacg

SEQ ID NO: 145190 - DNA, 631 bp, Homo sapiens
  misc_feature: GYAE6OF01CQ819.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagcctccagccaagaatactccaagagctaactacatacgcctaggtaaccagcaagaacgcctaggcccaggcctaccccgaggtttccctcacttcctatcggccgtcgggtcccagacgggcccacgtcggcacgtcccaggacctaggttcaggtcggcgtaggtcgggtctaggggaacaggtacttcgaccttctactatctaagttcgactagacgtggacgccgtagaagtctttcgacgtagtgttaattacgtgtacgagctaagttagtagggtacttccaccttcgtacggttccggttaccggaccgtaaacggggtaacccgtaaagggttaaacgaaaacgttacgggtaaaaaccggtacgttgggtacggtactacggacctaaccgtgttcgttacg

SEQ ID NO: 145191 - DNA, 704 bp, Homo sapiens
  misc_feature: GYAE6OF01AIEXU.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaacgcctggccaggcctcccaggttccctcatctatcgcgtcgggtcccacgacgggcccacgtcggaccactccccgaaggacctacgggtttccaagggttcgggaccgtaagggtttcggggtcctagggggaacctacggtacctttaccgaaccgttcctacaattccgtaagtttacggcctaacggtaccgttagggaacgtcccgttaggtaaacgtacgttttccggactaggttacgttaactttacgtggtacctaagtcgtaaggttacgttacgggtaacgtttcctaacccgttcgttacggttaccggtttaccgggaccgtaaacggggtaacccgtaaaggggttaacggtaaaacgttacgggtaaaaccggtaacgttagggttacgggtaccgttacggaccgtaaccctagttcgttacg

SEQ ID NO: 145192 - DNA, 531 bp, Homo sapiens
  misc_feature: GYAE6OF01BMCNH.21.4.A04.1.454.CMB.1.raw
  modified_base (347)..(347): a, c, t, g, unknown or other
  misc_feature (347)..(347): n is a, c, g, or t
  modified_base (459)..(459): a, c, t, g, unknown or other
  misc_feature (459)..(459): n is a, c, g, or t
  modified_base (492)..(492): a, c, t, g, unknown or other
  misc_feature (492)..(492): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgacccacaacatggactgggtccgccaggctccgagggagggctggagtgggtcgcgtatacaaggaanctaacagttacagtacagaatacggcgcgtctgtagaaggaggttcaccatctacaagagatgattacaaagaactcactgtatcagacaaatgaacagacctagaaaccgnggaccacggccgtagtattagttggtaggtaanaacgaaagaggtaggagtggtggtaggtagcgtggtacg

SEQ ID NO: 145193 - DNA, 503 bp, Homo sapiens
  misc_feature: GYAE6OF01B15BW.21.4.A04.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (435)..(435): a, c, t, g, unknown or other
  misc_feature (435)..(435): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccaccggagaaattgtgttgacgcagtctccaggcaccctgtctttgtctcaggggaaangccacctctcctgcagctccagccaagaatatccagagctaactacatagcctggaccagcagaagcctggccaggctccaggttcctnatctatgcgtgggtcccagacgggccacgtggccatcccagacaggttcagtggcaggtgggtctgggacagtacttcactctcatcattagcagactggacgcgtagaagtatttcgcgtagttgtattacgtgtcagcagtanaggtatcactctgtcgtcgacgaggacgtaagtagaatagaaacgacgtgacgntacanacatcgtcg

SEQ ID NO: 145194 - DNA, 517 bp, Homo sapiens
  misc_feature: GYAE6OF01D6ZC1.21.4.A04.1.454.CMB.1.raw
  modified_base (200)..(200): a, c, t, g, unknown or other
  misc_feature (200)..(200): n is a, c, g, or t
  modified_base (511)..(511): a, c, t, g, unknown or other
  misc_feature (511)..(511): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctcgggtcccacgagggccacgtggcactcccagacaggttcagtggcaggtgggtctgggacagacttcactctcatcattagcagactggagcctagaagtatttcgctagttgtattactgtcagctagtatggtattcacctctgtcgttcggaccgtaacgggacctaaggtagaatacggaaacgacgtggtacggtctagacacctntcgtcg

SEQ ID NO: 145195 - DNA, 514 bp, Homo sapiens
  misc_feature: GYAE6OF01C6UY5.21.4.A04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (507)..(507): a, c, t, g, unknown or other
  misc_feature (507)..(507): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctntcctgcagctccagccagaatatccagagctactacatagcctggtaccagcagaagcctggccaggctccaggttcccnatctatgctgggtcccagagggccatggcatcccagcaggttcaggtggcaggtcgggtctggggacaggtaccttcaacgttctcatcattagcagactggagcctagaagatttcgctagtgtattactgtcagtcagtagtaggtaattcacttctgtcgttcggacgaacgggtacaaggtagaaataggaacgacgtggtacgctagacacntcgtacg

SEQ ID NO: 145196 - DNA, 501 bp, Homo sapiens
  misc_feature: GYAE6OF01AR8S2.21.4.A04.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcccncatctatgctgggtcccacacggggccactggcatcccagacaggttcagtggcagtgggtctgggacagacttcactctcatcattagcagacgtggacgcctagaagtatttcgcagttgtattactgtacagcagtatggtaattcactgtcgtcgttcggccaagggaccaaggtagaatagaaacgatgnggctagcacntcgtg

SEQ ID NO: 145197 - DNA, 494 bp, Homo sapiens
  misc_feature: GYAE6OF01CV9CI.21.4.A04.1.454.CMB.1.raw
  modified_base (199)..(199): a, c, t, g, unknown or other
  misc_feature (199)..(199): n is a, c, g, or t
  modified_base (308)..(308): a, c, t, g, unknown or other
  misc_feature (308)..(308): n is a, c, g, or t
  modified_base (437)..(437): a, c, t, g, unknown or other
  misc_feature (437)..(437): n is a, c, g, or t
  modified_base (489)..(489): a, c, t, g, unknown or other
  misc_feature (489)..(489): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaanatccaccctctcctgcagctccagccagaatatccagagctactacatagcctggtaccagcagaagcctggccaggctcccaggttcctcatctatgctgggtcccanagggccactggcatcccagacaggttcagtggcagtggtctgggacagacttcactctcatcattagcagactggagcctagaagtatttcgctagtgttattactgtcagcagtatggaagttcactntgtcgttcgccaagggtccaaggtagaaatgaaacgacgtgtggctgacacntcgtg

SEQ ID NO: 145198 - DNA, 511 bp, Homo sapiens
  misc_feature: GYAE6OF01C3BN0.21.4.A04.1.454.CMB.1.raw
  modified_base (200)..(200): a, c, t, g, unknown or other
  misc_feature (200)..(200): n is a, c, g, or t
  modified_base (505)..(505): a, c, t, g, unknown or other
  misc_feature (505)..(505): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccagagggccacgtggcatcccagacaggttcagtggcaggtgggtctgggacagtacttcactctcatcattagcagactggagcctagaagtatttcgctagtgtatttactgtacagctagtagtggtaagttcacttctgtcgttcggaccaagggaccaaggtagaaagtaggaaaacgactgtaggctagcaccntcgtcg

SEQ ID NO: 145199 - DNA, 496 bp, Homo sapiens
  misc_feature: GYAE6OF01D8QAE.21.4.A04.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (444)..(444): a, c, t, g, unknown or other
  misc_feature (444)..(444): n is a, c, g, or t
  modified_base (491)..(491): a, c, t, g, unknown or other
  misc_feature (491)..(491): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctctcctgcagctccagccagaatatccagagctactacatagcctggtaccagcagaagcctggccaggctcccaggttccnatctatgctgggtcccacgagggccactggcactcccagacaggttcagtggcaggtgggtctgggacagtacttcactctcatcattagcagacgtggacgcctggaagtatttcgactagtgtattactgtcagctagtagtggtattcactntgtcgtcggcaaggacaaggtagaatagaacgatgagtcagacactntcgtg

SEQ ID NO: 145200 - DNA, 501 bp, Homo sapiens
  misc_feature: GYAE6OF01A7L3C.21.4.A04.1.454.CMB.1.raw
  modified_base (290)..(290): a, c, t, g, unknown or other
  misc_feature (290)..(290): n is a, c, g, or t
  modified_base (495)..(495): a, c, t, g, unknown or other
  misc_feature (495)..(495): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttccncatctatgctgggtcccacgagggcccactggcatcccagacaggttcagtggcagtgggtctgggacagacttcactctcatcattagcagactggagcctagaagtatttcgcagttgtattactgtcagcagtagtggtaattcactctgtcgttcggcctaaggacaaggtagaatagaaacgatggacggtctagacacntcgtcg

SEQ ID NO: 145201 - DNA, 553 bp, Homo sapiens
  misc_feature: GYAE6OF01EJVZI.21.4.A04.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtagtgatcaggggagagctgctcagttaggacccagagggaaccatggaaaccccagcgcagcttctcttcctcctcgcctactctggctcccaggctcagaaaccaccggagaaattgtgttgacgcagtctccaggccaccctgtctttgctcaggggaaagngccaccctctcctgcagctccagccagaatactaccagagcttactacatagcctaggtaccagcagaacgcctggccaggctcccaggtttccncatctatcgcgtggtcccagaggccactggcacgtcccagactaggttcagtggcaggtcggtctggacaggacttcacttctcatcattagcagtactggacncctagaacgtatttcgactagtagtaattactgtacagacgtagtagtaggtaacgttctactcgttcgtccgttcggaccgaagggaccgtaaagggtaacgtaaagtacggaaaccgtacgtggtacggtactacgaccacctgtctacg

SEQ ID NO: 145202 - DNA, 507 bp, Homo sapiens
  misc_feature: GYAE6OF01AV66Q.21.4.A04.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctccaggttccncatctatgctgggtcccanagggccacgtggcatcccagacaggttcagtggcagtgggtctgggacagacttcactctcatcattagcagactggagcctagaagatttcgctagtgtattactgtacagcagtatggtaattcacttctcgtcgttcggaccaagggaccaaggtagaaagtaggaaacgtactggtacggctagacactatcgtacg

SEQ ID NO: 145203 - DNA, 739 bp, Homo sapiens
  misc_feature: GYAE6OF01C6BQZ.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgccaccctctcctgcagctccagccagaatatccagagctactacatagcctggtaccagcagaacgcctggccaggctcccaggttcctcatctatgcctcgggtcccacgagggcccacgtggaccacgtccccaaggtaccacgggtttccgaagggttcgggaccgtaaggggttcgggttccgtggggaacctagggacctttcgaacctttctacctaatactaagttacggacgtaacggtacgtagggtacgtaccgtaggtaacgtacgtttaccggacgttaggttagttaacgtttacgttacggttacctacggtaccgtaaggttaacgttacggggttaaacgtttaccgtaacccgtttaccggtttacgggttacccgggtttaccgggtacccggtaaaacgggggtaaacccgtaaaaggggttaaacggtaaaacggttaacgggtaaaacccggttaaccggttagggttacgggtaccgttacggaacccgtaaccgttaagttcccgtttacgg

SEQ ID NO: 145204 - DNA, 528 bp, Homo sapiens
  misc_feature: GYAE6OF01D4CTS.21.4.A04.1.454.CMB.1.raw
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (462)..(462): a, c, t, g, unknown or other
  misc_feature (462)..(462): n is a, c, g, or t
  modified_base (491)..(491): a, c, t, g, unknown or other
  misc_feature (491)..(491): n is a, c, g, or t
  modified_base (521)..(521): a, c, t, g, unknown or other
  misc_feature (521)..(521): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagcctggagggtccctgagactctcctgtgcagcctctgcattcaccttcagtgaccacaacatggactgggtccgccaggctccgagggagggctggagtgggtcgcgtatacaaggaagctaanagttacagtacagaatacgggcncgtctgtagaaaggaaggttcaccatctacaagagatgattacaaagaactcactgtaatctagacaaatgaacagacctagaaaccgnggacacggcctagtattagttgaggtaanaacgaaaagagtgaagtggtaggtggtagngtgtacg

SEQ ID NO: 145205 - DNA, 500 bp, Homo sapiens
  misc_feature: GYAE6OF01BV40M.21.4.A04.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (436)..(436): a, c, t, g, unknown or other
  misc_feature (436)..(436): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaanatccaccctntcctgcagctccagccagaatatccagagctactacatagcctggtaccagcagaagcctggccaggctcccaggttcctcatctatgctgggtcccacagggccacgtggcactcccagacaggttcagtggcagtgggtctgggacagacttcactctcatcattagcagactggagcctgaagatttcgctagtgtattactgtcagcagtatggtattcactntgtcgttcggcctaagggaccaaggtagaaagtacgaaacgactgtaggctgacaccatcgtcg

SEQ ID NO: 145206 - DNA, 749 bp, Homo sapiens
  misc_feature: GYAE6OF01B8YN1.21.4.A04.1.454.CMB.1.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
tcagtcgtcgctcgcacgaccggtgctcgatttagagtagtgatcaggggagagctgctcagttaggacccagagggaaccatggaaacccagcgcagcttctcttcctctgctactctggctcccaggctcagaaaccaccggagaaattgtgttgacgcagtctccaggcacctgtctttgctcgagggaaancgccacctctcctgcagctccagccagaatanccagagctactacatagcctggtaccagcagaagcctggccaggcctccgaggttcccacatctatcgctcgggtacccacgacgggccacgtcgggacaacgtccccgaaggaaccgtagggtttaccaagggttcgggaccgtaaggggttcggggttaccgtagggggaaccaacgggtacccttttaccgaaccgttccgtactaacttacccgtaagttttaacggaccgtaacggaaccggttaggggaaccgtacccgttaagggtaaaagtttacgttttccggacgttaaggtttacgtttaaacgtttaccgtaggttaccgaaggtaccgtaagggtttacggttaacgggtaaaccgttttacccgtaacccgtttcggttacgggtttacccgggttaaccgggaacccgtaaaacggggtaaacccgtaaaaggggttaaacgaaaacggttacggaaaaccgtaacgttggttacgggacttacggacctaccgtattccggttacg

SEQ ID NO: 145207 - DNA, 507 bp, Homo sapiens
  misc_feature: GYAE6OF01CZRWW.21.4.A04.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
  modified_base (364)..(364): a, c, t, g, unknown or other
  misc_feature (364)..(364): n is a, c, g, or t
  modified_base (443)..(443): a, c, t, g, unknown or other
  misc_feature (443)..(443): n is a, c, g, or t
  modified_base (499)..(499): a, c, t, g, unknown or other
  misc_feature (499)..(499): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccaccctctcctgcagctccagccaagaatatccaganctactacatagcctggtaccagcagaagcctggccaggcctcccaggttcctcatctatgctcgggtcccanacgggcccacgtggcatccccagacaggttcagtggctagtgggtctgggacngacttcactctcatcattagctagactggacgctagagtatttcgctagtgtattactgtcagtcagtatgattcactntgtcgtcggaccaagggaccaaggtagaaataggaaacgacgtgtgtctagcaacnttcgtacg

SEQ ID NO: 145208 - DNA, 566 bp, Homo sapiens
  misc_feature: GYAE6OF01EPEPQ.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcacctgtctttgtctcgaggggaangccacctctcctgcagcctccagccagaatatccagagctactacatacgctggtaccagcagaacgcctggccaggcctccccgtagggtttccctcattctagtcgcgttcgggtacccacgacgggcccacgtggcactcccagactaggttcaggtcggcaggtgggtctgggacagtacttcactctcatctattagcagacgtggacgtcctaggaacgtactttcgactagttgttactttacgtgtacagctaagtagtagggtaacttccacttcgtcggttcgttccggaccgtaacgggaacctaagggtaacgaaagtacggaaaacgtacgttggacgtctcgacacctgtcgtcg

SEQ ID NO: 145209 - DNA, 497 bp, Homo sapiens
  misc_feature: GYAE6OF01CZJAB.21.4.A04.1.454.CMB.1.raw
  modified_base (201)..(201): a, c, t, g, unknown or other
  misc_feature (201)..(201): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
  modified_base (437)..(437): a, c, t, g, unknown or other
  misc_feature (437)..(437): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
tcagtcgtcgctcgcacgaccggtgctcgatttagagtagtgatcaggggagagctgctcagttaggacccagaagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccagagggccatggcatcccagacaggttcagtggcagtgggtcngggacngacttcactcncatcattagcagactggacgctagagtatttcgctagtgtattacngtcagcagtatgggaattcacttntgtcgttcggaccaagggtaccaaggtacaatggaaacgactgnggctagcaccngtctg

SEQ ID NO: 145210 - DNA, 546 bp, Homo sapiens
  misc_feature: GYAE6OF01ER4SR.21.4.A04.1.454.CMB.1.raw
  modified_base (199)..(199): a, c, t, g, unknown or other
  misc_feature (199)..(199): n is a, c, g, or t
  modified_base (417)..(417): a, c, t, g, unknown or other
  misc_feature (417)..(417): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaaantccaccctctcctgcagctccagccagaatatccagagctactacatagcctggtaccagcagagcctggccaggctcccaggttcctcatctatcgcgttcgggtccccacgacgggcccaacgtcggccactcccagacaggttcagtggcaggtgggtctgggacagtacttcacttctcatcattagcagactggagcctagaacgtatttcgntagtgttattactgtcagctagtagtggtaagttcctacttcgtgtccggttacggaccgaaacgggacctaagggtaacgaaagtacgaaaacgtacgtggtacggtactacgacacctagtccgtcg

SEQ ID NO: 145211 - DNA, 500 bp, Homo sapiens
  misc_feature: GYAE6OF01E4YMW.21.4.A04.1.454.CMB.1.raw
  modified_base (201)..(201): a, c, t, g, unknown or other
  misc_feature (201)..(201): n is a, c, g, or t
  modified_base (496)..(496): a, c, t, g, unknown or other
  misc_feature (496)..(496): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgctgggtcccacagggccactggcatcccagacaggttcagtggcaggtgggtctgggacagacttcactctcatcattagcagactggagcctgaagatttcgctagtgtattactgtcagcagtagtggtaagttcaccttctgtcgttcggccaagggaccaaggtagaaatagaaacgactggtggctgacaccntctg

SEQ ID NO: 145212 - DNA, 512 bp, Homo sapiens
  misc_feature: GYAE6OF01DEAEH.21.4.A04.1.454.CMB.1.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (505)..(505): a, c, t, g, unknown or other
  misc_feature (505)..(505): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcaccctgtctttgctccaggggaaangccacctctcctgcagctccagccagaatatccagagctactacatagcctggtaccagcagaagcctggccaggctcccaggttcctnatctatgctcgggtcccagacgggcctacgtggcaactccccagactggttcagtggcaggtgggtctgggacngtacttcactctcatcattagcagactggacgctagagtactttcgctagtgttattactgtcagctagtagtggtagttcacttctgtcgttcggaccgaaggtacaaggtagtaaatagaaacgaacgtgtcggctagcacnttcgtcg

SEQ ID NO: 145213 - DNA, 516 bp, Homo sapiens
  misc_feature: GYAE6OF01CSBK7.21.4.A04.1.454.CMB.1.raw
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (508)..(508): a, c, t, g, unknown or other
  misc_feature (508)..(508): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcaccctgtctttgtctccaggggaagagccaccctctcctgcagctccagccagaatatccagagctactacatagcctggtacagcagaagcctggccaggctcccgaggttcctcatctatgctcgggtcccagacgggccacgtggcactcccagactaggttcaggtgcaggtggtcnggacngacttcactcacatcattagcagactggacgctagaagtattcgctagtgttattactgtcagcagtagtagtagttcaccttcgtgtcgttacggcaaagggaccaaggtaagaaattaggaaaacgtacgtggtaggctagccaacngtcttacg

SEQ ID NO: 145214 - DNA, 565 bp, Homo sapiens
  misc_feature: GYAE6OF01AKMUL.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacgacgggccacgtggcactcccagacaggttcaggtgcaggtgggtctgggacagacttcactctcatcattagcagacgtggagccgtagaagtagtttcgctagtgttacttacgtgtcgagcgtagttagtaggtaacgttcaccttcgtcggttcgttccggaccgtaaacggggaaccgtaaagggtaacgtaaagtacggaaaacggtaacgttaggttacggaccgttaggaccgtacctagtccgttacg

SEQ ID NO: 145215 - DNA, 754 bp, Homo sapiens
  misc_feature: GYAE6OF01DJ62E.21.4.A04.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgctattcaccttcagtcgaccacaacagtcggactcggggtccgccaggcctaccgaggggaagggctgggagtgggtcggccgtattacgaaaggaanctaaacagttaacagtaacagaacgtacggcgtcgtctaggtaggaaagggtaacggttaccaaccgtataccgtacgaaaggaagtaacgtaggtaatttaaccgaaaaggtaaacccttacgtaaccttaggtaacttacgtacgtaaccgtaaaacgttaacggaaacccgaacgggtaaccccgttaaacgggaaaaaaccccggtaacggggaaacccgtaacccggggttacccggttaacggtttaaaagttttaacggtttaacgggttaacggggttaaacggaaaaccggtaaaaaacggggtagggtttaacggggtaaaggtttacggggttagggggtttaaggggttaacggttaccggttaggggttaaacccggg

SEQ ID NO: 145216 - DNA, 567 bp, Homo sapiens
  misc_feature: GYAE6OF01BTKAR.21.4.A04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggcctccaggttccncatctatgctcgggtcccacgacgggcccacgtggcactcccagacaggttcagtggcaggtggtctgggacagacttcactctcatcattacgcagtacgtggacgccgtagaagtactttcgctagtgtatttacgtgtcagctaagttagtaggtaagttctaccttcgtcggttcgttccgggaccgtaaacgggtaaccgtaagggtaagtaaagttacgggaaaccgtaacgttacggtacggtacgtacggacctaccgtagttccgttacg

SEQ ID NO: 145217 - DNA, 509 bp, Homo sapiens
  misc_feature: GYAE6OF01B4K9C.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctcgggtcccacgagggccacgtggcatcccagacaggttcagtggcaggtggtctgggacagacttcactctcatcattagctagactggacgtctagaagtatttcgactagtgtattactgtacagcagtatggtagttcactctgtcgtcgacgagggacgaaggtagaatacggaaacgtacgtagtggactagacactgtcgtacg

SEQ ID NO: 145218 - DNA, 508 bp, Homo sapiens
  misc_feature: GYAE6OF01BQLAM.21.4.A04.1.454.CMB.1.raw
  modified_base (200)..(200): a, c, t, g, unknown or other
  misc_feature (200)..(200): n is a, c, g, or t
  modified_base (405)..(405): a, c, t, g, unknown or other
  misc_feature (405)..(405): n is a, c, g, or t
  modified_base (450)..(450): a, c, t, g, unknown or other
  misc_feature (450)..(450): n is a, c, g, or t
  modified_base (491)..(491): a, c, t, g, unknown or other
  misc_feature (491)..(491): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccgaggttcctcatcctatgcgtgggtcccacacgggccacgtggcatcccagacaggttcagtggcaggtgggtctgggacagacttcactctcatcattacgcagactggacgcctagaagtntttcgctagttgtattacgtgtcagcagtagtggaagttcacctntgtcgtcggcaaggaccaaggtacgaatggaaacgtagtgngactgacactgtctacg

SEQ ID NO: 145219 - DNA, 528 bp, Homo sapiens
  misc_feature: GYAE6OF01EQW27.21.4.A04.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (394)..(394): a, c, t, g, unknown or other
  misc_feature (394)..(394): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctctcctgcagctccagccagaatatccagagctactacatagcctggtaccagcagaagcctggccaggctcccaggttcctnatctatgctgggtcccagagggccactggcatcccagacaggttcagtggcaggtggtctgggacagcttcactctcatcattagcagactggacgcctgaagtnttcgctagtgttattacgtgtcagctagtagtaggtacgttctactcgtcgtcggttcggaccgaacgggaaccgtaagggtaacgtaaagtacggaaacgaacgtggtacggtcgtacgaccactagtcgtcg

SEQ ID NO: 145220 - DNA, 498 bp, Homo sapiens
  misc_feature: GYAE6OF01C3QLB.21.4.A04.1.454.CMB.1.raw
  modified_base (200)..(200): a, c, t, g, unknown or other
  misc_feature (200)..(200): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgggcaccctgtctttgtctccaggggaaanatccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggancctagaagtntttcgctagttgtattactgtcagcaagtatggaagttcactctgtcgttcggccaagggaccaaggtagaaatggaaacgactgtgctgacacatctgtc

SEQ ID NO: 145221 - DNA, 560 bp, Homo sapiens
  misc_feature: GYAE6OF01BERZS.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctccaggttcctcatctatgctgggtcccacgacgggccacgtcggacactccccagaccgtaggttccaggtcggctaggtcgggtctagggacagtacttcgacttctacatctagttagcagacgtggacgtctagaagtagtttcgctagttagtaattactgtacagtctaagttataggtaacgttcactcgtgtcgttcggaccaaagggtacctaagggtaagtaagtaaggtaaacgaacgtggtacggtcgtagaccacctagtccgttacg

SEQ ID NO: 145222 - DNA, 531 bp, Homo sapiens
  misc_feature: GYAE6OF01ESUO2.21.4.A04.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanatccaccctntcctgcagctccagccagaatatccagagctactacatagcctggtaccagcagaagcctggccaggcctccaggttccnatctatcgcgtcgggtcccacgacgggccacgtggcacgtcccagactaggttcaggtggcaggtgggtctgggacagcttcactctcatcattagcagactggacgctagaagtatttcgactagtagtacttacgtcgtacagcaaggtagtaggtaattctactcgtgtcgttcggaccgaagggaccgaaggtaagaaataggaaacgacgtggtacggactagaccactgtcgtcg

SEQ ID NO: 145223 - DNA, 790 bp, Homo sapiens
  misc_feature: GYAE6OF01CY2FU.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctccaggctcagaaaccaccggagaaattgtgttgacgcagtctccaggccacctgtctttgctccgaaggggaaancgccacctctcctgcagctccagccaagaatactccagagcctactacatacgccttggtaaccagacaagaacgccgtaggaccgacggcctaccccgtaggtttccctactaacttcgtaacgtcggtaccgttaccggggtaccccaacggtacggggaccctaacggttcgggacctaaccgttaccccgaaggtaaccgtagggtttccgaagggttcgggaccgtagggttcggggttcgtacggggaactacggtacctttacgacttctacgtatactaacgttacgactaaggtacgttacgggacgtaccgtaaggtaaagttacgttttcggaacgttaggtttacgtttaatttacgtcggtacctaaggtaccgtaaggtttaacggttaacgggttaaccgtttacccgtaaccgttttcgttacgggtttacccggtttaacccgggaacccgaaaacgggggtaacccgttaaaaggggtaaacggtaaaacgttaaacgggtaaaaaccggtaacgtttacgggaccgggttaacccttacggaaccccgttaaacgtcggtttccgtttaccg

SEQ ID NO: 145224 - DNA, 594 bp, Homo sapiens
  misc_feature: GYAE6OF01BZGJY.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaacgcctggcccaggcctccccgaggttccctcatctatcgcgtgggtccccacgacgggcccacgtggccactcccagactaggttcaggtggcaggtcgggtctgggacagtacttcactctcatcattacgcagacgtggacgtcctagaagtactttcgactagttgttaactttactgtacagtctaagtagtaggtaacgtttccacccgttcgttcggttccggttaccgggaccgtaaacggggtaacccgtaaagggtaacgtaaaagtacggaaaaccgtacgttggtacggtacctacggacctacctagttccgttacg

SEQ ID NO: 145225 - DNA, 514 bp, Homo sapiens
  misc_feature: GYAE6OF01A3PZE.21.4.A04.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (286)..(286): a, c, t, g, unknown or other
  misc_feature (286)..(286): n is a, c, g, or t
  modified_base (495)..(495): a, c, t, g, unknown or other
  misc_feature (495)..(495): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttgctccaggggaangccacctntcctgcagctccagccagaatatccagagctactacatagcctggtaccagcagaagcctggccaggcctcccaggttccncatctatgctgggtcccacgagggccacgtggcactcccgagacaggttcagtggcaggtgggtctgggacagtacttcgactctcatcattagcagactggagcctagaagtatttcgctagtgtattactgtacagctagtagtaggtaacttcaccttgtgtcgtcggacctaagggaccaaggtagaagtaggaaacgacgtagnggtctagacactgtcgtcg

SEQ ID NO: 145226 - DNA, 499 bp, Homo sapiens
  misc_feature: GYAE6OF01D65ZY.21.4.A04.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (404)..(404): a, c, t, g, unknown or other
  misc_feature (404)..(404): n is a, c, g, or t
  modified_base (444)..(444): a, c, t, g, unknown or other
  misc_feature (444)..(444): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccctnatctatgctcgggtcccacgacgggccactggcactcccagacaggttcagtggcaggtgggtctgggacagacttcactctacatcattagcagactggagccgtagaagtntttcgctagtgtattctgtcagcagtataggtattcactntgtcgtcgacaggacaaggtagaatggaaacgtacgtgngtctagacacntctcg

SEQ ID NO: 145227 - DNA, 674 bp, Homo sapiens
  misc_feature: GYAE6OF01BPPDC.21.4.A04.1.454.CMB.1.raw
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (664)..(664): a, c, t, g, unknown or other
  misc_feature (664)..(664): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatcggagtttgggctgagcgtgggttttccttgttgttattttacaaggtgtccagtgtgaggtgcagctggtggagtcgtgggggagacttggtccagcctggagggtccctgagactctcctgtncagcctctgctattccaccttcagtcaccacaacatggactgggtccncaggctcgagggagggctggagtggtcgccgtatacgaaggaagctaacgagttacagtaacagaactacgggcgcgttcgtggtacggaaagggtaacgggttaccaaccgtaagttaccgttaaccgaaaaggaaggtaagttagtaaacgtttaacgaaaaacggtaaaccttaccgtaaacgttagtttaaccttaccgttaagaacctaaaacgttaagaaacccgtacggtaaacccgttaaacggaaaaacccgggagggaacccgaacgggtcccggttaagttaacgttaagtttacgggtaggttaacgaaacgtaaaaggtaggtaggtaagtggtagggtaggtacgngtcggtaacg

SEQ ID NO: 145228 - DNA, 659 bp, Homo sapiens
  misc_feature: GYAE6OF01DUTZ7.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaangccacctctcctgcagctccagccagaatatccagagctactacatagcctaggtaccagcagaagcctggccaggcctccccaggtttccctcgatctatcgccgttcgggtcccacgacgggcctacgtcgggacactcccaaggaccaggttcaggtcggctaggtgggtctggggactaggtacctttcacgttctaccgaacctactaccaacaccgtacgtcgggaccgtaccgtagtaacgttagttttacgacgtacgttacgttaacgtttacgtcgttacgtagtagttacggttaagttacgggttacggttaccgtaaccggttaccgtacccgtttacgggaccggtaacggggtaaccgtaagggtacgggtaacggtaacgtacgaacgggtaaccggtaacggttggtacggtacgttacggaccgaccgtagttccgttaccg

SEQ ID NO: 145229 - DNA, 691 bp, Homo sapiens
  misc_feature: GYAE6OF01ESJBW.21.4.A04.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctcaggggaaancgccacctctcctgcagcctccagccaagaatactccagagctactacatacgcctggtaccagcagaacgcctggccaggcctcccgaggttccncatcctagtcgcgtcgggtacccacgacggccacgtggaccactcccgaagacgtaggttcgaggtcgggactagggtcgggtcgtacggggaactacggtaccttacgaccttcgtactaagttcctaagtttacgacgaaggtacgtggaacgtaccgtaaggtaaacgttacgttttaccggacgttaacggttacgtttaacgtttacgtaggttacctaaggtaccgtaagttaggtacgggttaaacgtttccgtaaccgtttccgttacgggttacccggttaccggggtacccgtaaaggggtaacccgtaaagggtaaacgtaaaagttacggaaaaccggtaacgttacgggtacggtcgtacgaccgtaaccgtacgttcgttaccg

SEQ ID NO: 145230 - DNA, 860 bp, Homo sapiens
  misc_feature: GYAE6OF01CYXD7.21.4.A04.1.454.CMB.1.raw
  modified_base (154)..(154): a, c, t, g, unknown or other
  misc_feature (154)..(154): n is a, c, g, or t
  modified_base (228)..(228): a, c, t, g, unknown or other
  misc_feature (228)..(228): n is a, c, g, or t
tcagtcgtcgctcgcacgaccggtgctcgatttagagtagtgatcagggggagagctgctctaggttacggacccaggaacggaaccagtaggaaccccagcgcagcttctcttcctcctgctactctggctccagctcagaacacgagaatgnttgacgcagtctccagcaccctgtcttgtctccagggaagagccaccctcctcctgcagcgtccagccagaatntaccgagagcctaactacgacgtagtaccctaggaccaaggacctaggaaaccgtccgtcggaccccaagggtccttccccgtaacggtttcccttactaagttccgtagtcgacccgttaccggggtaaccccaacgggaccgggacccctacggttacggaccctaaccgtccccaaggtaccgtagggtttaccgaggttcggggacgtacggggtttcggggtacgtaggggaaccttaacggtacccgtttccaccgttaccgtacctaagtaccgtaacgttaacggccctaaggtacccgttagggtaccgtaccggttaaaggtaaacgttttcggtttaccggttaacgtttaaacgggtttacgtttttaaacgtttaccgttacgggttaaccgtaaacggttaccctttaaaaggggtttaaaccgttttccggggtaaaccgtttttccccggaacccggtttaccggtttcggttaacccggggtttaacccgggaacccggtaaaaacggggttacccggtaaaaaggtttaacgggaaaaccgttacggtaaaaaccgtaccgggttaggtacgggtaccctacggtaacctacccggttattccggtttaacccg

SEQ ID NO: 145231 - DNA, 576 bp, Homo sapiens
  misc_feature: GYAE6OF01DLKBS.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggacagagccaccctctcctgcggggccagtcaaattgttacccgcgactacttagcctggtaccagcagaaacctggccaggctcccagactcctcatccacaatatacttctacgagggcccgcgggcatcccagacaggttcagtggcagtggtctgggacagactttcactctcaccatcagcagactggagcctagaagtatttgactaatgtacttactgtacagactaatactcgtcctacccgaaccccccgtataccctaccgtttaccggacccgaacgggaaccaccggtaacctacgacgaacgagtacggaaaacgtaacgtaggtcggacgtacgacgtaaccctacttaccttcgttccttctaccg

SEQ ID NO: 145232 - DNA, 531 bp, Homo sapiens
  misc_feature: GYAE6OF01DDWB1.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccaccctntcctgcagctccagccagaatatccagagctactacatagcctggtaccagcagaagcctggccaggctccaggttccncatctatgctgggtcccacgagggccactggcatcccagcaggttcagtggcaggtgggtctgggacagtcttcactctcatcattagcagactggacgtcctagaagtatttcgctagtgttatttacgtgtacagctagttagtaggtaagttcaccttcgtgtccgttacggaccgaaagggacctaaagggtagaaagtaggaaacgacgtaggtacggtactagaccactagtcgttacg

SEQ ID NO: 145233 - DNA, 572 bp, Homo sapiens
  misc_feature: GYAE6OF01BL7MG.21.4.A04.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (564)..(564): a, c, t, g, unknown or other
  misc_feature (564)..(564): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaacgcctggccaggcctcccaggttccncatctatcgcgttcgggtcccacgacgggccacgtggcactcccagacaggttcaggtggcaggtggtctgggacagacttcacttctcatctattagcagacgtggagccgtagaacgtagtttcgacgtagttattacgttacgtgtacgagtacgtagttaagtagggtaagttcctaccttcgttcgttcggttcggaccgtaaacgggaccgtaaaggtaacgaaagtacggaaacgtacgttaggtcggtacgtcgacctaaccgtnttcgtacg

SEQ ID NO: 145234 - DNA, 491 bp, Homo sapiens
  misc_feature: GYAE6OF01BPZHW.21.4.A04.1.454.CMB.1.raw
  modified_base (199)..(199): a, c, t, g, unknown or other
  misc_feature (199)..(199): n is a, c, g, or t
  modified_base (399)..(399): a, c, t, g, unknown or other
  misc_feature (399)..(399): n is a, c, g, or t
  modified_base (440)..(440): a, c, t, g, unknown or other
  misc_feature (440)..(440): n is a, c, g, or t
  modified_base (485)..(485): a, c, t, g, unknown or other
  misc_feature (485)..(485): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttcctcatctatgcgtgggtcccagacgggccactggcactcccagacaggttcagtggcagtgggtctgggacagcttcactctcatcattacgcagactggacgtctagaagtntttcgctagtgtattactgtacagcagtatagtattcactntgtcgtcgacaggacaggtagaatagaacgatggagctagacacntcgtcg

SEQ ID NO: 145235 - DNA, 527 bp, Homo sapiens
  misc_feature: GYAE6OF01C45MS.21.4.A04.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (354)..(354): a, c, t, g, unknown or other
  misc_feature (354)..(354): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (518)..(518): a, c, t, g, unknown or other
  misc_feature (518)..(518): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanacgccacctctcctgcagctccagccagaatatccagagctactacatagcctggaccagcagaagcctggccaggcctcccgaggttcctnatctatgctcgggtcccagcgggccactggcactccagacaggttcagtggcaggtgggtcngggacagtacttcactctcatcaattacgacagtacgtggacgtctagaagtatttcgctagtnttatttacngtacagctagtatagggtacttcaccttgtgtcgttcggacaagggtacaagggtacaaagtagaaacgtactggtacgcttacgacaacngttcgtacg

SEQ ID NO: 145236 - DNA, 590 bp, Homo sapiens
  misc_feature: GYAE6OF01C2NYC.21.4.A04.1.454.CMB.1.raw
  modified_base (372)..(372): a, c, t, g, unknown or other
  misc_feature (372)..(372): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacttggtccagccctgggagggtccctgagactctcctgtgcagcctctgctattccaccttcagtcgaccacaacagtaggactcggggtcccgccgaggcctaccggaggggaacggggctgggaggtcgggtcggaccgtatacgaaggaanctaaacagttacaagtacagaatacggcgcgtctagtaggaaaggtagttcaaccatctacaagagtatagtatacaaagtaactcactgtactactagacaaatagaacagacctaacggaaaaccgaggaccgacggtaccgtagtaacgttagtggtaaggtaagaaacgtaaaaggtaggtaggagttagggtagggtaggtagcgttggtacg

SEQ ID NO: 145237 - DNA, 522 bp, Homo sapiens
  misc_feature: GYAE6OF01D74O5.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctcgggtcccacgacgggccacgtggcatcccagacaggttcagtggcaggtgggtctgggacagacttcactctacatcattagcagactggagccgtagaagtatttcgctagttgtattacgtgtcagcagttagtaggtattcacgttctcgttcgttcggaccgaagggacctaaggtagaaataggaaacgacgtgtacggctagacacctgtcgtacg

SEQ ID NO: 145238 - DNA, 553 bp, Homo sapiens
  misc_feature: GYAE6OF01B0UKH.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaacgcctggccaggcctcccgaggttcctcatctatgctcgggtcccagacgggccacgtggcactcccagacaggttcaggtggcaggtcgggtctagggactaggtacttcactctacatctattagcagacgtggacgtcgtagaagtattcgactagtgtattacgtgtcagctagtagtaggtacgttctaccgttcgtcgtccggttccggaccgtaacgggaaccgtaaggtagaaagtacggaaacgtaacgtggtacggtctacgaccacctgtcgtacg

SEQ ID NO: 145239 - DNA, 496 bp, Homo sapiens
  misc_feature: GYAE6OF01DXBOL.21.4.A04.1.454.CMB.1.raw
  modified_base (199)..(199): a, c, t, g, unknown or other
  misc_feature (199)..(199): n is a, c, g, or t
  modified_base (490)..(490): a, c, t, g, unknown or other
  misc_feature (490)..(490): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttcctcatctatgctgggtcccacagggccactggcatcccagacaggttcagtgcagtggtctgggacagacttcactctcatcattagcagactggagcctagaagtatttcgcagttgtattactgtcagcagtatggagttcactctgtcgttcggccgaagggaccaaggtaagaaatagaaacgtactgtaggctagcacntcgtcg

SEQ ID NO: 145240 - DNA, 507 bp, Homo sapiens
  misc_feature: GYAE6OF01BZGQ8.21.4.A04.1.454.CMB.1.raw
  modified_base (200)..(200): a, c, t, g, unknown or other
  misc_feature (200)..(200): n is a, c, g, or t
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccaggttcctcatctatgctgggtcccacgagggccactggcactcccagacaggttccagtggcaggtgggtctgggacagacttcactctcatcattagcagactggacgctagaagtatttcgctagtgttattactgtcagcagtatggtattcactctgtcgtcggacgaaggaccaaggtagaatacggaaacgacgtgnggtctcgaccactntcgtcg

SEQ ID NO: 145241 - DNA, 565 bp, Homo sapiens
  misc_feature: GYAE6OF01BE8KC.21.4.A04.1.454.CMB.1.raw
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttccncatctatcgctcgggtcccacgagggccacgtggcactcccagacaggttcaggtggcaggtggtctgggacagacttcactctcatcattagcagacgtggagcctagaagtacttcgcgtagttgttattacgtgtacagtctagtagtaggtaacgttcaccttcgtcgttccggttcggaccgtaagggaacccgtaagggttaaacgtaaagtacggtaaaaccgtaacgtggtacgggtacctacggaccaaccgtagttccgttacgg

SEQ ID NO: 145242 - DNA, 596 bp, Homo sapiens
  misc_feature: GYAE6OF01A6964.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaancgccaccctctcctgcagctccagccagaatatccagagctactacatagcctggtaccagcagaacgcctggccaggcctcccgaggttccctcatctatcgctcgggtcccacgacgggcccacgtggccacgtccccagaccgtaggttcaggtggcgtaggtgggtctggggacaggtcttcactctacatcattagcagactggacgcctagaagtagtttcgctagttgtatttacgtgtcagctaagtagtacgggtaagttccaccgttcgtcggttccggttccgggaccgtaaacggggaacccgtaaagggttaacgtaaaaggtacggtaaaacggtaacgttggtacgggtaccgtacgaccgtaaccgtagttccgttacgg

SEQ ID NO: 145243 - DNA, 801 bp, Homo sapiens
  misc_feature: GYAE6OF01DF8T9.21.4.A04.1.454.CMB.1.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcagaaaccaccggagaaattgtgttgacgcagtctccaggcacctgtctttgctcgagggaaancgccacctctcctgcagctccagccaagaatanccagagctactacatagcctaggaccagcaagaagcctggccaggcctcccgtaggttcctacatctatcgcgtcgggtcccacgacgggccacgtcgggaccacgtccccaaggaccgtacgggttccaagggttcggaccgtaaggggtttcggggtaccgtagggggaacctaacggttaacccgttttaccgaaccgtttcccgtacctaaacgttacccgttaaacgttttaaacgggacccgtaaacggtaccggttaacggggtaaaccgttacccgttaagggtaaaacggttaaccgtttttacccgggaaccgttaagggttttaacgtttaaaccgttttaacgtttacggtaacctaaacggtccgttaaaggttaacggttacggggttaaaccgtttcccgtaaccgtttccggtttacggttaccgggtttacccgggaaccggtaaaacggggtaaaccgtaaaacgggttaaacggtaaaagttaaccgggtaaaaaccggtacgttacgggtacgtaccggtacgtaacccgtaacgttacgttcgtttaccgg

SEQ ID NO: 145244 - DNA, 562 bp, Homo sapiens
  misc_feature: GYAE6OF01DAUT6.21.4.A04.1.454.CMB.1.raw
  modified_base (198)..(198): a, c, t, g, unknown or other
  misc_feature (198)..(198): n is a, c, g, or t
  modified_base (554)..(554): a, c, t, g, unknown or other
  misc_feature (554)..(554): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaaangccaccctctcctgcagcctccagcccagaatactccagagctactacatagcctggtaccagcagaagcctggccaggctccccaggttcctcatctatgctcgggtcccagcgggccatggccactcccagacgtaggttcagtggctaggtgggtctgggacaggtaccttcacttcgtacatactattacgactacgactggacgcgtagaagtatttcgactagttgttactttacgtgtcagtactagttagtaggtagttctacgttcgttgtcggttccggaccgaaacgggtaccgaaaggtaacgaaagtaggaaaccgaactggtacggtctacgacctaaccgntcgttacg

SEQ ID NO: 145245 - DNA, 534 bp, Homo sapiens
  misc_feature: GYAE6OF01BLHPB.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
tcagtcgtcgctcgcacgaccggtgctcgatttagagtagtgatcaggggagagctgctcagttgggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtcccacgagggccactggcactcccagacaggttcagtggcaggtgggtctgggacagtacttcacttctcatcattagcagactggacncgtagaagtntttcgctagtgtattactgtcagcagtagtggtaacttcaccttgtcggtcgttccggaccgtaagggacctaaagggtaacgtaaagtacggaaacgtacgtggtacggtactagaccacctagtcgtacg

SEQ ID NO: 145246 - DNA, 537 bp, Homo sapiens
  misc_feature: GYAE6OF01EJZCB.21.4.A04.1.454.CMB.1.raw
  modified_base (464)..(464): a, c, t, g, unknown or other
  misc_feature (464)..(464): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttcctgttgttatttacaaggtgtccagtgtgaggtgcagctggtggagtctgggggagacttggtccagcctggagggtccctgagactctcctgtgcagcctctgcattcaccttcagtgaccacaacatggactgggtccgccaggctccgagggaagggctggagtgggtcgccgtatacgaaggaagctaacagttacagtacagaatacggcgcgtctggtacgaaaggaggttcaaccgatctacaagagatagattacaaagactcactgtatctagacaaatgaacagacctagaaaaccgnggaacacggccgtagtacgttattggtaggtagaacgaaagacggtaggagtggtaggtaggtagcgtgtacg

SEQ ID NO: 145247 - DNA, 565 bp, Homo sapiens
  misc_feature: GYAE6OF01EY5H9.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttcctcatctatcgctcgggtcccacgacgggccacgtggcactcccagacaggttcagtggcaggtggtctgggacagcttcgactctcatcattacgcagtacgtggacgtccgtagaagtatttcgactagttagttattacgtgtacagcgtaagtagtagggtaacgttcctaccgttcgtacgttccggttcggaccgtaaagggaccgtaaagggtaacgtaaagtacggaaacgtaacgtggtacggtacgtacgacctactagttcgtacg

SEQ ID NO: 145248 - DNA, 610 bp, Homo sapiens
  misc_feature: GYAE6OF01BX0HS.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatagcctggtaccagcagaacgcctggccaggcctccccgaggttccctacacttcctatcgcgtcgggtacccacgacgggccacgtggccactcccgagactaggttcaggtggctaggtggtctagggacagtacttcactctcatctagttacgcagacgtaggacgcctagaagtactttcgactagtgttacttacgtgtacagtactaagttagtaggtaacgttccgtaaccttcgtacggttccggttacgggaccgtaaacggggtaaccctaaagggttaacgtaaagtacgggtaaaaccgtaacgttacggttacggtacttacggaacctaacccgttagttccgttacg

SEQ ID NO: 145249 - DNA, 584 bp, Homo sapiens
  misc_feature: GYAE6OF01EO65A.21.4.A04.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaaangccacctntcctgcagctccagccagaatatccagagctactacatacgcctggtaccagcagaacgcctggccaggcctcccgaggttcctcattctagtcgcgttcgggtacccacgacgggcccacgtcggactactcccgaagacctaggttccaggttcggaccgtagggttcgggtctaggggaactacggtacctttcgacttctacatcaattagcagactggacgcgtagaagtagtttcgactagttgtattacgtgtcagtctagtagtaggtaacgttcacttgtcgtcgttacggaccgtaagggaaccgtaagggtaacgtaaagtacggaaaacgtacgtaggtacggtactaggaccacgtatcgttacg

SEQ ID NO: 145250 - DNA, 538 bp, Homo sapiens
  misc_feature: GYAE6OF01BNJY7.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgctcgagggaangccacctctcctgcagctccagccagaatatccagagctactacatagcctggtaccagcagaagcctggccaggcctccaggttcctcatctatcgctcggacccacgacggccacgtggcactccagacaggttcaggtggcaggtcggtctagggacagtacttcactctacatactattacgcagtacgtggacgcctaggtaagtactttacgactagtgttattacgtgtacagctagtagtggtaacttctactcgtgtcgttcggacgaagggtaacctaagggtaagaaataggaaacgacgttaggtcggactacgacctactgtccgttacg

SEQ ID NO: 145251 - DNA, 507 bp, Homo sapiens
  misc_feature: GYAE6OF01DD043.21.4.A04.1.454.CMB.1.raw
  modified_base (200)..(200): a, c, t, g, unknown or other
  misc_feature (200)..(200): n is a, c, g, or t
  modified_base (359)..(359): a, c, t, g, unknown or other
  misc_feature (359)..(359): n is a, c, g, or t
  modified_base (500)..(500): a, c, t, g, unknown or other
  misc_feature (500)..(500): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagagctactacatagcctggtaccagcagaagcctggccaggctcccaggttcctcatctatgctgggtcccagagggccactggcactcccaagacaggttcaggtggcaggtgggtctgggacngacttcactctcatcattagctagactggagcctagaagtatttcgctagtgtactttactgtcagcagtatggtagttcacttctgtcgttcggaccaagggaccaaggtaagaatagaaacgactgaggtctagacacngtctacg

SEQ ID NO: 145252 - DNA, 509 bp, Homo sapiens
  misc_feature: GYAE6OF01EDW4X.21.4.A04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttccnatctatgctgggtcccagagggccactggcatcccagacaggttcagtggcagtgggtctgggacagacttcactctacatcattagcagactggagcctagaagtatttcgctagtgttattactgtcagctagtatggtaagttcaccttcgtgttcgttcgaccgaagggaccaagggtacaagtacgaaacgacgtgtaggctagacacctgtctcg

SEQ ID NO: 145253 - DNA, 536 bp, Homo sapiens
  misc_feature: GYAE6OF01AZ2BH.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (306)..(306): a, c, t, g, unknown or other
  misc_feature (306)..(306): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccaccctntcctgcagctccagccagaatatccagagctactacatagcctggtaccagcagaagcctggccaggctcccaggttcctcatctatgctgggtcccanagggccactggcactcccagacaggttcagtggcagtgggtctggacagacttcacttctcatcattagcagactggagcctagaagtatttcgctagtgtattacgtgtcagcgtagtagtgggtaacttcaaccttcgtgtccgttcggaccgaagggtaaccgtaaggtaacgaaagttacggaaaacgtacgtaggtacggtcgtacgacctacctagttcgtacg

SEQ ID NO: 145254 - DNA, 683 bp, Homo sapiens
  misc_feature: GYAE6OF01DWENO.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaggtgtcagtgtgaggtgcagctggtggagtcgtgggggagacgttggtccagccgtggacgggtccctgagactctcctgtgcagcctctgcattcaccttcagtcgaccaacaacagtcggacgtcgggtcccgccgaggcctaccggaggggaacgggcgtgggaggtcggggtccggccgtaagttaaccgaaaggaagactaaacgtagttaacgagtaacagtaacgtaccgggcgtacgtacgtaggtaaggaaacgggtacggtttaccaactagttcctaacgaaagaagtattagaattaacgaaaagtaacctctaacttacgttatacttagaactaaaagtcgaaaaccgtaacgtacctaaacgggaaaaaccgcggaaccgtacccgggtacgttagttaaagtttaagtttagggaacggttaaagaaaacgtaaaaagggtcggttagggtaacgttaggggtagggttagggtaagtccggttaggtaaccg

SEQ ID NO: 145255 - DNA, 554 bp, Homo sapiens
  misc_feature: GYAE6OF01B0FHX.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaacgcctggccaggcctcccgaggttcctcatctatgcgtcgggtcccacgacgggccactggcactcccagacaggttcagtggcaggtgggtctgggacagtacttcactctcatcattagcagactggagcctagaagtatttcgctagttgttattacgtgtacgagctaaggtagtaggtaagttcaccttcgttcgttacggttccggaccgtaaagggaccgtaagggtacgtaaagtacggaaacggaacgtggtacggtcgtacgacctacctagtcgtacg

SEQ ID NO: 145256 - DNA, 575 bp, Homo sapiens
  misc_feature: GYAE6OF01BQ9K8.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagctccagccagaatatccagagctactacatagcctggtaccagcagaacgcctggccaggcctcccgaggttccctcatctatcgcgtcgggtcccacgacgggccacgtcggcacgtcccaagacgtaggttcaggtcggctagggtcgggtcgtaggggacaggtacttcactctcatctattagcagtacgtggacgtcgtagaagtctttcgactagtgtattacgtgtcagctagtagtaggtaacgttcaccgttcgtcgttccggttaccggaccgtaacgggaaccgtaaggtaacgaaagtacggaaaacgtacgtaggtacggtactacgaccaacctgtcgtacg

SEQ ID NO: 145257 - DNA, 494 bp, Homo sapiens
  misc_feature: GYAE6OF01AXYQU.21.4.A04.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (446)..(446): a, c, t, g, unknown or other
  misc_feature (446)..(446): n is a, c, g, or t
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttcccnatctatgctgggtcccacgagggcccacgtggccactcccagaccaggttcagtggcaggtgggtctgggacagacttcactctcatcattagcagactggacgcctagaacgtatttcgactagtgtattacgtgtcagcagtatgattcactntgtcgtcgcaggacaaggtnaatgaaacagtgagctagacacngtctg

SEQ ID NO: 145258 - DNA, 541 bp, Homo sapiens
  misc_feature: GYAE6OF01BLJBB.21.4.A04.1.454.CMB.1.raw
  modified_base (216)..(216): a, c, t, g, unknown or other
  misc_feature (216)..(216): n is a, c, g, or t
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
  modified_base (534)..(534): a, c, t, g, unknown or other
  misc_feature (534)..(534): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagactctcctgtgcagcctctgcattcaccttcagtgaccacaacatggactgggtccgccaggctccgagggagggctggagtgggtcgcgtatacgaaggaagctaacagttacagtacagaatacggcgcgtctgtagaaaggagttcacatctanaagagatagattacaaagactnactgtatctgacaatgaacagtacctaaggaaaacccgaggaaccacgggtaccgtagttaattagttaggtaggtaanaacgaaaaggngtaggatggtaggtaggtagngtgtacg

SEQ ID NO: 145259 - DNA, 781 bp, Homo sapiens
  misc_feature: GYAE6OF01DW98H.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggccaccctgttctttgtctccgaaggggaaancgcccaccctctcctgcagcctccagccaagaatactaccagacgctaactacagtacgcctaggtaaccagacaagaacgccgtggacccaggtcctcccgtaggttccctactacttctagtcggccgttccgggtacccacggacgggtccctaacgtcggacctaaccgtcccgaaggtaccgtacggttcgagggttcgggacgtacggggttcgggtacgtaggggaacctacgtaccgtttcacgttctactataccgtaagttacgacgtaaggtacgtagggacgtaccgtaggtaacgttacgtttcggacgttaggtttacgttaacgtttacgtacggtacgtaaggtacgttaaggttacggtacgggttaaccgtttccgttaccgtttcggtttaccgggttaccgggttaccggggaaacccggttaaaaccgggggtaaaccgttaaaaggggttaaacggttaaaaacgggttaaccgggtaaaaaccggttaacgggttacgggtaaccgggtaccgttaccggtaacccgttaaccggttacgttccggtttaaccgg

SEQ ID NO: 145260 - DNA, 693 bp, Homo sapiens
  misc_feature: GYAE6OF01BUEE4.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgctccgaggggaaancgcccaccctctcctgcagctccagccagaatactccagagctaactacatacgcctggtaccagcagaacgcctggccaggcctccccgtaggttccctacagttcctagtcggccgttcgggtccccaaggacggggccccaacgtcgggacctaccgtaccccgaaggacctaggtttcgaggtcggacgtagggtcgggtaccgtggggaaccacggttaccttaccgacttccgtacaacttaccgtaagttacggcaacggtacgttagggacgtaccgttaggaacgttacgtttcggacgttaaggttagttaacgtttaacgtcggtaccgtaaggtaccgtaagttacgtacgggtaacgtttcctaccgttcgttacggttaccggttccggaaccgtaaacgggtaaccgtaaagggtaacgtaaagtaacggtaaaacggtacgtaggtacggtcacggtactacctagttcgttaccg

SEQ ID NO: 145261 - DNA, 564 bp, Homo sapiens
  misc_feature: GYAE6OF01BLF74.21.4.A04.1.454.CMB.1.raw
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactgggtccncaggctccgagggaagggctgggagtgggtcgaccgtatacgaaggaaanctaacagttacagtacaagaactacggcncgtctgtagaaggtagtcacatctanaaganatgaattacaaagaactacactgtactctagacaaatacgaacacgtaccgtaacgaaaaccggagaccgacggtccgtaagttaactttagttaggtggtaagaaacgaaaaggaggtaggaagttggtaggttaggtagtcgtgtaacgg

SEQ ID NO: 145262 - DNA, 515 bp, Homo sapiens
  misc_feature: GYAE6OF01BZNH0.21.4.A04.1.454.CMB.1.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatcgctgggtcccacagggccactggcatcccagacaggttcagtggcagtgggtctgggacagacttcactntcatcattagcagactggagcctagaagtatttcgcagttgtattactgtacagcagtatggtaagttccactctgtcgttcggaccgaagggaccaaagggtaagaaataggaaaacgacgttaggtcggctagacacctagtctcg

SEQ ID NO: 145263 - DNA, 677 bp, Homo sapiens
  misc_feature: GYAE6OF01CRESB.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaggggaaagcgccaccctctcctgcagcctccagccaagaatactccagagctaactacatacgccttaggaccagacaggaaacgcccgtggaccaacgggtcccttaccccgtaagggtttcccctacgaacttccgttaacgtcggtcccgttaccgggggtaccccaacggaccggggccctaacgtcgggccaaccgtccccgaagtaccgtaggttccgaagggtcgggactagggtcgggtcgtagggaacctagtacctttcgacttcgtaccatactaagttacgacgtacgacgtggactaccgtaggtaacgtattcgactaggttataacttacgtgtactacgcgtaagtagtacggtaagttacctacgtcgttacggtccgttaccgggtaccgaaacgggtaaccgtaaagggtacgtaaagacggtaaaacgtacgtgtacggtctacggacctacgagttccgttacg

SEQ ID NO: 145264 - DNA, 707 bp, Homo sapiens
  misc_feature: GYAE6OF01C8VSM.21.4.A04.1.454.CMB.1.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggcaccctgtctttgtctccgagggaancgccacctctcctgcacgctccagccaagaatacnccgaagacgtactactaacagtagccgttacggaaccagcaaggaacgtccgtcggaccgtacggccttaccccggtaggtttcccctactacttaccttacgtcgtccggtccgggtacccacggacggggccctaacgtcggactaaccgtcccgaagacgtacggtcaggtcggcgtaggtcggtcgtaggactagtccttcacgtcacgtatactattacgctacgacgtggactacgtagtaacgtacgtttccgagtaggtttacttaacgtttcgtacgtacgacgtacgttaaggttacgttaacgggttaaccttcctaacccgtttcggtttaccgggtaccggtttacccgggaaacgggtaaacccggggtaaacgtaaagggttaaaacgggtaaagttaaccgggaaaacgttaccgtggtagggtacccttacgaaccgttaacctgtacccgtttacg

SEQ ID NO: 145265 - DNA, 523 bp, Homo sapiens
  misc_feature: GYAE6OF01EGMYH.21.4.A04.1.454.CMB.1.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (416)..(416): a, c, t, g, unknown or other
  misc_feature (416)..(416): n is a, c, g, or t
  modified_base (518)..(518): a, c, t, g, unknown or other
  misc_feature (518)..(518): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggcctcccaggtttcccncatctatcgcgtcgggtacccncgacgggccacgtggcactcccagacctaggttcagtggctaggtgggtctgggacagtacttcactctcatcattagcagacgtggacgcctagaacgtntttcgctagtgttattacgtgtcagtcagtagtggtaagttctactctcgtcgtcggaccgaaggtaccaggtagaataggaaacgagtgcggtctgacacntctcg

SEQ ID NO: 145266 - DNA, 636 bp, Homo sapiens
  misc_feature: GYAE6OF01BJ1VU.21.4.A04.1.454.CMB.1.raw
  modified_base (200)..(200): a, c, t, g, unknown or other
  misc_feature (200)..(200): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccacctgtctttgctccgaggggaaancgccaccctctcctgcagcctccagccaagaatactccaagacgctactacatacgcctaggtaccagacagacgcctaggccaggcctccgaggttcccnattctatcgtcgtcgggtacccaggacgggcctacgtggacactcccgagtaccgtaggttcaggtcggctagggtcgggttctacgggactacggtacctttcaccgttctactactacgtaattacgacgtacggtacgtcggacgtactaggtaacgtagttacgagtacgttagttattacgttcgtacgtacgtacgtaagttagtacggtaacgttctaccgttcgttcggtccggttacgggaaccggtaacgggaacgtaagggtaaacgtaaacgtacggaaaacgtacgttaggtacggtactacggacctacgtgttcgttacg

SEQ ID NO: 145267 - DNA, 610 bp, Homo sapiens
  misc_feature: GYAE6OF01DSBLT.21.4.A04.1.454.CMB.1.raw
  modified_base (198)..(198): a, c, t, g, unknown or other
  misc_feature (198)..(198): n is a, c, g, or t
  modified_base (300)..(300): a, c, t, g, unknown or other
  misc_feature (300)..(300): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcaccctgtctttgtctcgaggggaancgccaccctctcctgcagcctccagccaagaatatccagagctaactacatacgcctaggtaccagcaagaacgcctggccacggtcctacccgaggttccncgtacttctatcggccgtcgggtacccacggacgggaccacgtcggcacgtcccgagacgtacggttcgaggtggacgtaggtcgggtcgtggggaactagtactttccgacttcgtactactactattacgctagtacgtacggacgtcgtagacgtacgttcgacgtagttagttacttactgtacgagacgtagtagtaggtacgttactaccgttcgtcgttcgttcggtaccgaacgggtaaccgaaaggtaacgtaaagtacggtaaacgtacgtggtacggtacgtacgacactagtcgttcg

SEQ ID NO: 145268 - DNA, 558 bp, Homo sapiens
  misc_feature: GYAE6OF01BEP95.21.4.A04.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (550)..(550): a, c, t, g, unknown or other
  misc_feature (550)..(550): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccgaggttcccnactctatcgcgtcgggtcccacgacgggccacgtggcctatccccagacctaggttcaggtggctaggtcgggtctgggacagtacttcactctcatctattacgctagacgtggacgccgtagaacgtatttcgctagttatagtttctgtacagtctaagtagtagggtaacttcacgttcgtacgtcgttccgacgtaacgggacctaaaggtacgaagtacggaaacgacgttgacggtactcggacaccgtntcgttacg

SEQ ID NO: 145269 - DNA, 506 bp, Homo sapiens
  misc_feature: GYAE6OF01C5BFV.21.4.A04.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (468)..(468): a, c, t, g, unknown or other
  misc_feature (468)..(468): n is a, c, g, or t
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagcctccagccagaatatccagagctactacatagcctggtaccagcagaagcctggccaggctcccaggttccncatctatgctcgggtcccagacgggccacgtggcactcccagacaggttcagtggcaggtgggtctgggacagtacttcactctcatcattagcagactggagctagagtatttcgctagtgttattactgtcagcagtagtgattcactctgtcgttcggccaagggaccaagggtanaatacggaaacgacgtggngtactagacacctntcgtg

SEQ ID NO: 145270 - DNA, 567 bp, Homo sapiens
  misc_feature: GYAE6OF01AZPAF.21.4.A04.1.454.CMB.1.raw
  modified_base (358)..(358): a, c, t, g, unknown or other
  misc_feature (358)..(358): n is a, c, g, or t
  modified_base (437)..(437): a, c, t, g, unknown or other
  misc_feature (437)..(437): n is a, c, g, or t
  modified_base (478)..(478): a, c, t, g, unknown or other
  misc_feature (478)..(478): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacatggactcgggtccgccaggctccgaggggaagggctgggagtgggtcggcgtatacgaaggaagctaanagttacagtacagaatacggcgcgtctgtagaaagggtacgttcaaccatctacaaagagatgaattacaaaagtactnaactgtactctagactaaatgaacagacctaagaaaaccgnggaccacgggtcctagttaacgttagttaggtacgggtaagaaacgaaaaggtagtaggattgggtagggttaggtagcgttaggtacg

SEQ ID NO: 145271 - DNA, 626 bp, Homo sapiens
  misc_feature: GYAE6OF01DJIYJ.21.4.A04.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaangccaccctctcctgcagctccagccagatanccagagctactanatagcctggtaccagcaagaacgcctggccaggctcccaggttcctcatctatgcctcgggtcccagacgggccacgtggccacgtcccgagactacggttcaggtcggctagggtggtcgtgggaacaggtaccttcgacttctacaatcgtaattacgcaaggtactggactcctaggaagttactttcgactagttcgttaagtttactgtacgtagtacgtaagttagtacgggtaacgtttcctaaccttcgtttacggttaccggttacccgggtaccgaaaacggggtaacccgtaaaggggttaacgaaaacgttaggtaaaacccgtaagttcgggtacggtaccttacggaaccttaccgaagttccgttacg

SEQ ID NO: 145272 - DNA, 542 bp, Homo sapiens
  misc_feature: GYAE6OF01CXRZC.21.4.A04.1.454.CMB.1.raw
  modified_base (201)..(201): a, c, t, g, unknown or other
  misc_feature (201)..(201): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (398)..(398): a, c, t, g, unknown or other
  misc_feature (398)..(398): n is a, c, g, or t
  modified_base (535)..(535): a, c, t, g, unknown or other
  misc_feature (535)..(535): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagcctccagccagaatatccagagctactacatagcctggtaccagcagaagcctggccaggctcccaggttcctcatctatcgctcgggtcccacgacgggccacgtggcactcccagacaggttcagtggcaggtgggtcngggacngtacttcactctcatctattagcagactggacnccgtagaagtatttcgctagtgttatttacgtgtacagtcagttagtaggtaagttcaccgttcgtgtcgttcggaccgaagggaccgaaggtaacgaaagtaggaaacgtacgtaggtacggtctacgaccacgtnttcgtcg

SEQ ID NO: 145273 - DNA, 873 bp, Homo sapiens
  misc_feature: GYAE6OF01A036N.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatactccagagctactacatagcctaggtaccagcagaagcctggccaggcctcccaggttccctcatctatcgccgtcgggtccccacgacggggtcccacgtggcacgtcccgagaccgtaggtttccaaggttgggaccgtagggttcggggtacgtaggggaacctacggtacctttaccaaccgttccgtaccgtaacgttaccgaaggtttaacggaccgtaacggtaaccgtttggggaacgtacccgttaagggtaaacggttacgttttacccgggacgttaacgggtttacggtttaacgttttaacccggttcggttaaccgaaggttacccggttaaacggtttaaacggttacgggggttaaaaccgtttttacccggtaaccccgtttaccggtttaccggggttttacccgggtttaaccccggggtaaccccgggttaaaaccggggggttaaacccccgttaaaaagggggtttaaacggtaaaaaaccgggtttaaccggggtaaaaaaacccccgggttaaacccgggtttaacggggttacccgggggggttaaaccccggtttaacggggtaaacccccgttaaaccccgggttaaaccggtttacccggttttaacccgggg

SEQ ID NO: 145274 - DNA, 643 bp, Homo sapiens
  misc_feature: GYAE6OF01BKAM8.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcacctgtctttgctccgaggggaaancgccacctntcctgcagctcagccaagaatatccaganctaactacatagcctaggaccagcaagaagtctggccaggctcccaggttcctnatctatcgctcggtacccacgagggccacgtggcactcccgagtactaggttcagtggactaggtcgggtctagggacagtacttcgactctcatctattagctacgtacgtggactccgtagtaagtatttaccggacgtaggtttacgttaactttacgttacgtaccgtaaggtaccgtaaggttacgtaacggggtaaacgtttacccaaccgttcgttacggttacccggttacgggaacccgtaaaacggggtaacccgtaaaaggggttaacgtaaaagttaacgggaaaaccggtaacggtttggtaccgggtactacggaacctaaccgtaagttccggttacg

SEQ ID NO: 145275 - DNA, 574 bp, Homo sapiens
  misc_feature: GYAE6OF01EJJFI.21.4.A04.1.454.CMB.1.raw
  modified_base (433)..(433): a, c, t, g, unknown or other
  misc_feature (433)..(433): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactgggtccgccaggcctccgaggggaagggctgggaggtgggtcggcgtatacgaaggaagctaacagtacagtacagaatacggcgcgtctgtagaaggtaggttcacatctacaagagatgattacaaagactcactntactctagaacaaatacgaaacacgacctaaacggaaaccgaggaccacgggaccgttaggttaattaagttggtagggtaagaaacgtaaaaggtacggtagggtaacgttgggtagggttagggtactcggtgtaacgg

SEQ ID NO: 145276 - DNA, 825 bp, Homo sapiens
  misc_feature: GYAE6OF01BOBWF.21.4.A04.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagctccagccaagaatacnccagagctaactanatacgcctaggtaccagcaagaacgcctggccaggcctcccgaggttccctacatcctatcggtcctcggggtcccaacggacgggccctacgtcgggacctaccgtcccgaaggtaaccgtagggtttaccaaggggtttcgggaccgtaaggggtttcgggggtaccgttagggggaaccctaacgggttaccttttacccggaacctttcccgttactaaacgttaccgtaacgtttaacggacccgtaacggtaaccgttcgggaaccggttacccgttaagggtaaacggttaaccgtttccggtacgtaagggtttacgttaacgttttaaccgttcggttaccgtaaggtaccgttaacggttaaggttaacgggttaaacggtttacccgttaaccgtttaccggttacgggttacccgggtttacccgggaaccggtaaaaccggggggtaaaccgtaaaacggggttaaaacgtaaaacgttaacgggtaaaaaaccggtacggttaaggttaccgggtaccggttacggtaacccgtaaacccgttacgttcccggtttaaccgg

SEQ ID NO: 145277 - DNA, 727 bp, Homo sapiens
  misc_feature: GYAE6OF01C5JL1.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctactacatagcctggtaccagcagaacgcctggccaggcctaccgaggttccctacattctatcgcgtcgggtacccagacgggcccagtcggccactccccgagaccgtacggttcgaggttcggcgtagggttcgggtccgtggggaactaggtacctttaccgacttccgtactatactaagtttacgaccgtaggtaccgttagggacgtaccgttaaggaacggttaacgtttccggtaccgttaaggttagtttaccgtttaacgttggttaccgtacgttaacgttaacgggttacgttaacgggtaaccgtttaccgtacccgtttcgttacgggttaccccggtttaccgggaacccgtaaaaccggggtaacccgtaaaaggggttaaaccgtaaaaggttaaccggtaaaaccgggtaaccgttaggggtacggttaccggtaacgtaccgtaacccctaagttccggtttaccg

SEQ ID NO: 145278 - DNA, 592 bp, Homo sapiens
  misc_feature: GYAE6OF01BRVU1.21.4.A04.1.454.CMB.1.raw
  modified_base (199)..(199): a, c, t, g, unknown or other
  misc_feature (199)..(199): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccacctctcctgcagctccagccagaatactccagagctaactacatacgcctggtaaccagcagaacgcctggccaggcctcccgtaggttccctcattctagtcgccgtcgggtcccagacgggccacgtggacactcccgaagacctaggttcaggtcggctaggtcgggtctggggaactaggtactttcgacttcgtacattctagttagcagtacgtggacgtccgtagaacgtatttcgntagttnttattactgtacgagctagtagtaggtaacgttcaccttcgtcgttccggttacggaccgtaacgggaaccgtaagggtaacgaaagttacggaaaacggtagtacggtacggtactacggacctactacgtcgttacg

SEQ ID NO: 145279 - DNA, 544 bp, Homo sapiens
  misc_feature: GYAE6OF01CMW6K.21.4.A04.1.454.CMB.1.raw
  modified_base (217)..(217): a, c, t, g, unknown or other
  misc_feature (217)..(217): n is a, c, g, or t
  modified_base (538)..(538): a, c, t, g, unknown or other
  misc_feature (538)..(538): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacgttgggtccaggcctgggagggtccctgagactctcctgtgcagcctctgcattcaccttcagtgaccacaacatggactgggtccgccaggctccgagggaaggggctgggagtgggtcggccgtagttacaaaggtaaagctaacagttacagtacagaatacggcacgtctgtagaaagaaggttcacagtactacaagagatagattacaaagaactacgactgtatctagacaaatagaacagacctagaaacgagacaacggccgtagtattacgtgtagtaagaacaaaagagtggaatgtaggtaggtagntgtacg

SEQ ID NO: 145280 - DNA, 579 bp, Homo sapiens
  misc_feature: GYAE6OF01EY7T3.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaangccaccctctcctgcagctccagccagaatatccagagctactacatacgcctggtaccagcagaacgcctggccaggcctcccgaggttccctcattctagtcgcgttcgggtacccacgacgggccacgtggaccactcccgagacctaggttcaggtggcaggtggtctgggacagaccttcactctcatcattagcagacgtggacgctagaagtctttcgactagttgttaattacgtgtctaggctaagtagtagggtaacgttctaccgttcgttcggttaccggtcgggaacccgtaaacggggtaacctaaagggtaacgaaagtacggaaaccgacgttggtacggtacgtacgacacgtattcgtacg

SEQ ID NO: 145281 - DNA, 821 bp, Homo sapiens
  misc_feature: GYAE6OF01AK2E0.21.4.A04.1.454.CMB.1.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggaccagcagaagcctggccaggcctcccgaggttcccncatctatgcgtcggggtcccacgacggggcccacgtgggccatccccgaaggacctagggtttccaagggttcgggccgtaagggtttcggggtacctgggggaacctacggtaccgtttccaaccgttccttaccgtaacttaccgtaagttttaacggccgtaacggtacccgttacggggtaaccggtacccgttagggtaaaacggttaccgtttttaccgggacctttaacggggtttacgtttaaacgtttttaaccgttcgggtttaaccgtaacgggttaccgttaaagggtttaacgtttacgggggttaaaaccgtttttcccgaaccccgttttaccggtttaccgggttacccggggttttaacccgggaaccccggtaaaaaccgggggtaaccccggttaaaagggggtttaaaccgtaaaaacggttacgggtaaaaaacccgggttaaccgttacgggttacggggtaaccctttacgggaaccccgttaacccgtaaagtttcccgtttaacgg

SEQ ID NO: 145282 - DNA, 746 bp, Homo sapiens
  misc_feature: GYAE6OF01AKXZF.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaanagccaccctctcctgcagctccagccagaatactccagagctactacatacgcctggtaccagcagaagcctggccaggcctcccaggttcctcatcctatcgctcgggtcccacgacgggccacgtggcactcccagacctaggttccaggtcggaccagggttcggggtactaggggaacctacggtacccgtttcaaccgtttcctaccgtaattaccgtaagtttacggaccgtaaggtaccgttacgggaacgtacccgtaggtaaacggttacgttttccggacgttaacggtttcggtttaactttacgttaggtaccgtaaggtacgtaaggttacggttacgggttaaacgtttccgtaaccctttcggttacgggtttacccgggtttaccgggaacccggttaaaacgggggtaacccgttaaaaggggttaaacggtaaaacgttaacgggtaaaaaccgggttaaaccgttacgggtacggggttaccctaacgggtaaccccgaaccgttaccggtttaccgtttacccggg

SEQ ID NO: 145283 - DNA, 732 bp, Homo sapiens
  misc_feature: GYAE6OF01BX38Z.21.4.A04.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (296)..(296): a, c, t, g, unknown or other
  misc_feature (296)..(296): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagctccagccaagaatatccaganctactacatagcctggtaccagcaagaagcctggccaggcctcccgaggttccnatctatcgcgtcgggtcccagacgggcccacgtggaccactcccgagtaccgtaggttccaggtcgggctaagggttcggggtaccttaggggaacctacggttaaccctttccgaacctttccgtactaattacgtaacgtttaacggacgtaacggtacgtacgggaacgtccgtaggtaacgttatttccggtacgtaggttagttaactttacgttggtaccgagtacgtaaggttaacgttacgggttaacgttaccgttacccgttacggttaccggtttcccgggttaaccgggtaacccgggtaaaacggggtaacccggttaaaacggggttaaacggtaaaacggttaaacgggtaaaaacccggtaacggttacgggttacggtaccgttaacggaacccgtaaccgttacgttcccggttacgg

SEQ ID NO: 145284 - DNA, 521 bp, Homo sapiens
  misc_feature: GYAE6OF01EWRBM.21.4.A04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
  modified_base (510)..(510): a, c, t, g, unknown or other
  misc_feature (510)..(510): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaaangccacctctcctgcagctccagccagaatatccagagctactacatagcctggtaccagcagaagcctggccaggctcccaggttcctnatctatcgctcgggtcccagagggccacgtggccagtcccagacaggttcaggtggcaggtggtctgggacagacttcactcgtcatcattagcagactggagccgtagtaagagtttcgactagtagtattactgtcagctagtataggtaacgttcactctcgtcgtcgaccgtaaggaccgaaggtagaaatacgaaacgacgtagtacggtactaganaccatcgtacg

SEQ ID NO: 145285 - DNA, 802 bp, Homo sapiens
  misc_feature: GYAE6OF01BOII1.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggcaccctgtcttgctcgagggaaancgccacctctcctgcagctccagccagaatactccagagactactacatacggccttaggaccaggcaaggaacgccgtggacccagggtcctacccgaggttccctacattcctagtcggtccgtcgggtaccccagtacgggcccacgtggacctactcccgaagacgtacggttcgaaggttcgggactaggtcgggtactagggaccctaggtaccttcgaccttcgtacactacgtaattacgacgtaacggtacgtagggaccgttaccggtaacgtaacgttaaccgttttccggaacgtttaacggttacgtttaacgtttaaacgttcggttaccgtaacggtaacgttaacggtttaaggtaaccggggtttaacgtttaccccggttaaccgtttaccggtttacgggttaaccccggggtttaccggtaaacccgggtaaaaccgggggttaaaccccggtaaaaaggggttaaacggtaaaaaccggttaacggggtaaaaaacccggttaaccggtttacggggtaaaccccgggttacgttaacccgggttaaccctaaaccccgtttcggttaccggtttaaacccgg

SEQ ID NO: 145286 - DNA, 521 bp, Homo sapiens
  misc_feature: GYAE6OF01A33HS.21.4.A04.1.454.CMB.1.raw
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctctcctgcagctccagccagaatatccagagctactacatagcctggtaccagcagaacgcctggccaggctcccgaggttccncatctatgctgggtcccagacgggccactggcactcccagacaggttcagtggcaggtgggtctgggacaggacttcactctcatcattagcagactggagcctagaagtctttcgctagtgtatttactgtacagctagtagtaggtaattctaccttcgtcgtcgttcggaccgaaacgggtaccaaggtacgaagtagaaacgtacgtgtagtctagacactgtctg

SEQ ID NO: 145287 - DNA, 503 bp, Homo sapiens
  misc_feature: GYAE6OF01C4I4A.21.4.A04.1.454.CMB.1.raw
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (449)..(449): a, c, t, g, unknown or other
  misc_feature (449)..(449): n is a, c, g, or t
  modified_base (473)..(473): a, c, t, g, unknown or other
  misc_feature (473)..(473): n is a, c, g, or t
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaagngccaccctctcctgcagctccagccaagaatatccagagctaactacatagcctggtaccagcagaagcctggccaggctcccaggttcctcatctatgcctgggtcccagcgggccacgtggccactcccagacaggttcagtggcaggtggtcngggacnggacttcactctcatcattagcagactggacgtctagagtatttcgcgtagtgttattacgtgtcagctagtagtggtattcacttntgtcgtcgacaagggtacaggtanaatcgaaacgactgnggctagcacntctcg

SEQ ID NO: 145288 - DNA, 698 bp, Homo sapiens
  misc_feature: GYAE6OF01ADVAR.21.4.A04.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaattgtgttgacgcagtctccaggcaccctgtcttgtctcgaggggaancgccaccctctcctgcagctccagccagaatactccgagacgtctactacatacgcctaggaccagcagaacgcctggccaggcctcccgaggttccnagtctatcgcctcgggtacccacgacgggcctacgtcggacctacgtccccgaaggtaccgtacggtttccaaggggttcggaccgtagggttcggggtacctaggggaaccctaggtaccctttccgaacttcctacgtactcgtaacgtttacgccgtaaggtaccgtagggtaccgtaccgttaggtaaacggtttacgtttaccggtacgtagttacgttaactttacgtgtaccgaagtcgttaaggtacgttacgggtaacgtttccgtaccgttcggtcggttaccggttccgggaaccgtaaacggggtaacccgtaaagggttaacgaaaggttacggtaaaacggtacgttaggtacggtaccgttacggaacctaccgtagttccggtttacg

SEQ ID NO: 145289 - DNA, 566 bp, Homo sapiens
  misc_feature: GYAE6OF01CNEO8.21.4.A04.1.454.CMB.1.raw
  modified_base (417)..(417): a, c, t, g, unknown or other
  misc_feature (417)..(417): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagacgccaccctctcctgcagctccagccagaatatccagagctactacatagcctggtaccagcagaagcctggccaggctcccaggttcctcatctatgcgtcggtcccacgacgggcccacgtcggcacgtcccagactaggttcaggtcggctaggtgggtctggggacagtacttcaacttctcatcattagctagactggactcgtagaagtntttcgatagtgttattacgtgtactagctaagtagtaggtaattcctacctgttgtccggttacggaccgaaagggtaccgaaagggttaacgaaagtacggaaaacgtaacgtggtacggtactacgacctaaccgtagttcgttacg

SEQ ID NO: 145290 - DNA, 519 bp, Homo sapiens
  misc_feature: GYAE6OF01A5PKN.21.4.A04.1.454.CMB.1.raw
  modified_base (407)..(407): a, c, t, g, unknown or other
  misc_feature (407)..(407): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
  modified_base (513)..(513): a, c, t, g, unknown or other
  misc_feature (513)..(513): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctggaggggtccctgagactctcctgtgcagcctctgcattcaccttcagtgaccacaacatggactgggtccgccaggctccgagggaaggggctgggagtgggtcggccgtattacgaaggaagctaacagttacagtacagaatacggcgcgtctgtgaaaggaggttcaccatcncaagagatgatacaaagaactcactgtatctgacaaatgaacagcctagaaaccgagacacggcgtgtattatgtggtanacaaagngtagagtgtaggtggtagngtgtcg

SEQ ID NO: 145291 - DNA, 582 bp, Homo sapiens
  misc_feature: GYAE6OF01A3QNX.21.4.A04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttccncatctatgctgggtcccacgacgggccacgtggcatcccagacaggttcagtggcaggtgggtctgggacagacttcactctcatctattagcagacgtggacgtcgtagaagtatttcgctagtgtattactgtcagtactagtagtaggtaacgtttccgtaccttcgttacggttccggtttaccgggacccgtaaacggggaacccgtaaaggggtaacgaaaagttacggtaaaaccggtaacgttaggtacgggtaccgttacggaaccaaccctaagttcgttaccg

SEQ ID NO: 145292 - DNA, 817 bp, Homo sapiens
  misc_feature: GYAE6OF01CUOEJ.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctcgaggggaaangccaccctntcctacagctccagccaagaatatccagacgctacanatagcctggtaccagcagaagcctggccaggctcccgaggttccncatcctatcgccgttcgggtcccacgacggggtccaacgttgggaccactccccgaaggacctaacggggtttccaagggttcgggactaaggttcggggttactagggggaacctaggtacctttcaacgttccttacgaacttccgtaagtttaacggaccgtaacggtaccgttacgggtaacggtacccgttaaggtaaacggttacgtttttaccggaccgttaaggttttacggttaacgtttaaccgtttcgggttaacctaacgggtaccgtttaaaggttaacgtttaaggggttaaaaccggttttccgtaaacccgttttcggtttaccgggttttacccgggtttacccggggtaacccggtaaaaacggggtaaaccccggtaaaaggggttaaaccggtaaaaacggtttaaccgggtaaaaaccggttaaaacgggtttacggttaccggggtaaccgttaccggggtaaaccctaaacccggttaacttacccggtttcggttttaaccccg

SEQ ID NO: 145293 - DNA, 569 bp, Homo sapiens
  misc_feature: GYAE6OF01EEP4H.21.4.A04.1.454.CMB.1.raw
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
  modified_base (561)..(561): a, c, t, g, unknown or other
  misc_feature (561)..(561): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctaactacatagcctggtaaccagcagaacgcctggccaggcctccaggttccncatctatgcgtcgggtcccacgagggccacgtggccactcccagacacggttcaggtgcaggtggtctgggacagacttcactctacatcattacgcagtacgtggacgtccgtagaacgtatttcgactagttgttattactgtcgagctaaggttagtacgggtaatttccgaccttcgtacgttccggttaccggaccgtaaacgggaccgtaaagggtaagtaaaacgtacggaaaacgtaacgtggtacggtctacgacaacctntcgttacg

SEQ ID NO: 145294 - DNA, 638 bp, Homo sapiens
  misc_feature: GYAE6OF01B9CD2.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatatccagagctactacatagcctggtaccagcagaacgcctggccaggcctcccgaggttcctcatctatcgcgtcgggtcccagacgggccacgtcggcactcccagaccgacggttcaggtggcgtaggtcgggtcgtgggaactaggtaccttcaacgttctactatactagttagctaagtacgtggacgtcgtaagaacgtacgtttcgagtagttagttattacgttgtacaggtacgtaagttagttaggtaacgttcctaaccgttcggttcggttacccggtttaccgggaacccggtaaacgggtaaccgtaaagggttaacggtaaaagttaacgggaaaaccgtaaccggttaggttacgggacgttacggaccgtaacctagttccgttacgg

SEQ ID NO: 145295 - DNA, 711 bp, Homo sapiens
  misc_feature: GYAE6OF01DF61W.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccaccctctcctgcagcctccagccaagaatactccagagctaactacatagcctggtaaccagcaagaagcctggccaggcctcccgaggttcctcatctatcgccgtcgggtcccagacgggcccacgtcggccactcccgaagacctaggtttccaggtcggcgtagggttcgggtctaggggaactaggtacttccgacttctacgatctaagttacgaccgtaaggaccgttgggacgtaccgttaggtaaacgtcgttttcggactaggttacgttaactttacgtcgttaccgaggtacgtaaggttaacgttaggggtaaaccgtttccgtaacccgttttcggttacgggtttcccgggttttaacccgggacccggtaaaaccgggggttaacccgtaaaacggggttaaacgtaaaacggtttaacgggaaaaacccgggttaaccgttagggttacgggtacccgttacggacccttaaaccgtacgttccgtttaccgg

SEQ ID NO: 145296 - DNA, 711 bp, Homo sapiens
  misc_feature: GYAE6OF01CIYZD.21.4.A04.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcacgaaaccaccggagaaattgtgttgacgcagtcctccaggccaccctgtctttgctccgaaggggaaancgcccaccctctcctgcagcctccagccaagaatacnccagacgcctaactacatacgccgtaggtaccagcaagaacgcctggaccaggcctccgaggttcccactactctatcgtcgtcggtacccacgacgggccacgtcggacctacgtcccgaaggtaccgtaacggtttccaagggtcggacgtagggttcggggtcgtacggggaacctacggtacccgtttcaaccttcgtactactactaacgttacgacgaagtacgtgggacgtaccgttaagtaacgttactttaccggacgttaagggttacttaacgtttacgacgttaacgaacgtacgtaacggttagttaacggggtaacctttaccgtaccgttccggttacggttaccgggttaccggaaccggtaaacggggtaaacgtaaacgggtaacgtaaaaggtaccgaaacggtacgttacgggacggtacctacgtaccctacgttacgttcgttaccg

SEQ ID NO: 145297 - DNA, 554 bp, Homo sapiens
  misc_feature: GYAE6OF01A2VU2.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaanatccaccctctcctgcagctccagccagaatatccagagctactacatagcctggtaccagcagaagcctggccaggctcccaggttcctcatctatgctgggtcccagagggccacgtggcatcccagacaggttcagtggcaggtggtctgggacagacttcactctcatcattagcagactggagtcctagaagtatttcgactagttgtaattacgtgtacagcgtaagttagtggtaacgttcaccgttcgtcgtccgttacggaccgtaaggggtaacctaaagggtaacgtaaagtacggaaaacgtaacgttggtacggtaccttagacctaacctagttccgttacg

SEQ ID NO: 145298 - DNA, 586 bp, Homo sapiens
  misc_feature: GYAE6OF01DSNKP.21.4.A04.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgttctttgctccgaggggaaangccaccctctcctgcagctccagccaagaatatccagacgctaactacatagcctaggtaccagcagaagcctggccaggcctcccgtaggttccctnattctatcgcgtcgggtcccagacgggccacgtggcactcccaagacaggttcaggtggacgaggttcgggtctgggacagtacttcgacttctactatctattacgctagacgtggacgtcgtagtaacgtagtttcgacgtagttagttaactttcgtgttacagtactaagttagtaggtaacgttcaccttgtcgtcggttaccggaccggaacgggaacctaaagggtaacgtaaagtacggaaacgtaacgttggtacggcttagacctactgtcgttacg

SEQ ID NO: 145299 - DNA, 551 bp, Homo sapiens
  misc_feature: GYAE6OF01AY1AU.21.4.A04.1.454.CMB.1.raw
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctgggagggtccctgacgactctcctgtgcagcctctgcattcaccttcagtcgaccacaacatggacgtgggtccgccaggctccgagggagggctggagtgggtcgcgtatacaaggaagctaanagttacagtacagaactacggcgngtctaggtagaaaggagtcacatcanagagatgattacaaagactcactgtactctgacaaatacgaacacgtacctagaaaccgaggacgacggtccgtagtaattacgttaggtacggtaagaacgaaaaggtggtaaggtagtggtagggttaggtagtcgtggtacg

SEQ ID NO: 145300 - DNA, 685 bp, Homo sapiens
  misc_feature: GYAE6OF01EXLK4.21.4.A04.1.454.CMB.1.raw
  modified_base (173)..(173): a, c, t, g, unknown or other
  misc_feature (173)..(173): n is a, c, g, or t
  modified_base (193)..(193): a, c, t, g, unknown or other
  misc_feature (193)..(193): n is a, c, g, or t
  modified_base (196)..(197): a, c, t, g, unknown or other
  misc_feature (196)..(197): n is a, c, g, or t
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
tcagtcgtcgctcgcacgaccggtgctcgattttagagtagtgatcagggagctctggagagccggaggcccaggccccacgaattccccaggtgttttctactttggtgtactctagcactgaacacagaggactacaccagtggagtttggctgagcgtggttctgtagtnttacgagttgtcagtgtagngtnngntggtgagtgtgggganacgttggtcgagccttggacggtcctgagactcgtccgtgngcctgtccctgtgctagttcctacgttcgaagttcaacccttagaactgtcggtacgttgggtacccgcgaggcctaccggagggggacgggctaggggacgtcggggtacggaccgttagtacggaaaggtaagtcctaagtaaggttacaggttaacaaggtaacgtacgggcgcgttacgtagggtagtaaacgggtagttccgaaactgtcgtaacgtaaggcgtattacgactacgaaacgacttcgaactacgtactacccgtagtaaccaacgttacgaaactacggtacctaaaggaaaaccgcggtaacgtaaccggtccgttaagttagtttaacggttacggcgggttaaaggaacctaaaagggtcgttagggtaactacggggtttacggtaaggtaacttcggtttaaaggtcgg

SEQ ID NO: 145301 - DNA, 867 bp, Homo sapiens
  misc_feature: GYAE6OF01B1065.21.4.A04.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcaccctgtcttgtctccgagggaaancgccacctctcctgcagctccagccagaatactccagacgctactacatacgcctggtaaccagaccagaacgccctagggcccaaggcctcccgaaggtttccctnactctagtcgccgttcgggtcccacgacggggacctacgtcgggaccacgtccccaaggtaaccgaacggtttcgaacggtcggggtaccgtaagggtttcggggttaccgtagggggaacctacggtaaccttttaccgaaccgttccttacgaacttaccgtaacgtttaacggaccgtaacggtaacccgttaggggtaaccgtacccggttaaggtaaacggttaacgtttttcccggaaccggtttaacggtttacgggtttaaccgttttaaccggtttacggtttaaccccggtaagggttacccgttaaagggttttaaccggttaacggggtttaaacgttttaccccgttaacccgttaccggtttacgggttaacccgggtttacccggggtaacccggtaaaacccgggggttaacccggtaaaaacgggggtttaaacggtaaaacggttaaacggttaaaaccccgggtaaacgtttaccggggttaacgggttacccggttaacggtaaaccccttaacccggtaaggtttacccggtttaacccgg

SEQ ID NO: 145302 - DNA, 694 bp, Homo sapiens
  misc_feature: GYAE6OF01C3YUS.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactcttgctcccaggctcagaaaccacggagaaattgtgttgacgcagtctccaggcaccctgtctttgtctccgaggggaaagagcccaccctctcctgcagctccagccagaatactccagagctactacatagcctggtaccagacaagaagcctgggccaggcctacccgaggttccctcatctatcgcctcgggtacccacgcgggccacgtggacactcccgagacaggttcaaggtggcaggttgggctcggggaactacggtactttccgaactccgtataactcgtaattacggactaacggtacgtaggtacgtaccgtaaggtaaacgtacgttttacggacgttaagttacggttaactttaccgttaggtacgtaacgtccgtaaggttaacgttacgggttaacgtttccgtaacccgtttaccggttaggtttcccggttaccgggtaacccggtaaaacggggtaacccgtaaaagggttaaacgtaaaacgttaacgggtaaaaaccggttaacgttacgggtaacggtaccgtacggactaacccgtagttccgtttacg

SEQ ID NO: 145303 - DNA, 742 bp, Homo sapiens
  misc_feature: GYAE6OF01BLYNV.21.4.A04.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcacctgtctttgctccgaggggaaancgccacctctcctgcagctccagccaagaatacnccagacnctaactanagtagcctaggtaccagacagaacgcctggaccaggcctcccgtaggttccctacgattctatcgtccgtcgggtacccaacggacgggccctacgtcggacctacgtccccgaagtaccgtaaggtttccgaagggttcgggacgtagggttcggggtacgtaggggaacctaggtaccctttacgaaccgttcttacaacgttaccgtaagtttacgaccgtaacggtaaccggtagggaacgtaccgtaaggtaacgttacgtttaccggacgtaaggtttacgttaacgtttacgttaggttaccgaggttacgttaagggttacgttaacggggttaactttaccgtacccgtttacgttacgggttaccggttaccgggtaaccgtaaacggggtaaacccgttaaaggggtaaacgtaaagttaacgggtaaaaaccgtacggttacggtacggtacgttacggtaacgtacgttacgtaagttccgg

SEQ ID NO: 145304 - DNA, 733 bp, Homo sapiens
  misc_feature: GYAE6OF01BIMMR.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgccacctctcctgcagctccagccagaatactccagacgctactacatagcctggtaccagcagagcctggccaggcctccgaggttccctcattctatcgcgtcgggtcccaacgacgggcccacgtcgggacctaacgtacccgaaggtaccgtagggtttaccaagggttcgggacgtagggtcggggtactacgggggaacctaggtacctttcgaacctttccgtaccgtaacttactaacgtttacgaccgtaacggtaccgttagggaaccgtacccgtaaggtaaacggttacgtttaccggacgttaaggtttacgtttaactttacgttcggtacgtaacggtacgtaaggttagttacgggttaaacgtttccgtaaccgttccgttacggttccggttaccgggaaccgtaaacggggtaaacccgtaaagggttaaacgtaaaacggttaacggtaaaaaccggtacgttagggtaccgggtaccttacggaaccgtaaccgtagttcggttaccgg

SEQ ID NO: 145305 - DNA, 508 bp, Homo sapiens
  misc_feature: GYAE6OF01A2ULQ.21.4.A04.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaanagccaccctctcctgcagctccagccaagaatatccagagctactacatagcctggtaccagcagaagcctggccagctccaggttcctnatctatgctgggtcccacgagggccacgtggcatcccagacaggttcagtggcaggtggtctgggacagacttcactctcatcattagcagactgagcctgaagatttcgcagtgtattactgtcagctaagtatggtaattcactgtgtcgttcggaccgaaggaccaaggtaagtaaagtggaaaacgtaagtgtacggctacgacacctagtctag

SEQ ID NO: 145306 - DNA, 521 bp, Homo sapiens
  misc_feature: GYAE6OF01D77JE.21.4.A04.1.454.CMB.1.raw
  modified_base (200)..(200): a, c, t, g, unknown or other
  misc_feature (200)..(200): n is a, c, g, or t
  modified_base (515)..(515): a, c, t, g, unknown or other
  misc_feature (515)..(515): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaacgcctggccaggcctcccaggttcctcatctatcgctcgggtcccacgacgggccacgtggccactccccagacctaggttcaggtcggcgtaggtgggtctgggacagtacttcactctcatcattagcagtactggagctagaagtatttcgctagtagtattacgtgtcagtcagtagtaggtattcactcgtcgtcgtcgacgaaggacaaggtagaagtagaacgacgtgtacgtctagacactntcgtcg

SEQ ID NO: 145307 - DNA, 568 bp, Homo sapiens
  misc_feature: GYAE6OF01BG14N.21.4.A04.1.454.CMB.1.raw
  modified_base (216)..(216): a, c, t, g, unknown or other
  misc_feature (216)..(216): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (420)..(420): a, c, t, g, unknown or other
  misc_feature (420)..(420): n is a, c, g, or t
  modified_base (489)..(489): a, c, t, g, unknown or other
  misc_feature (489)..(489): n is a, c, g, or t
  modified_base (535)..(535): a, c, t, g, unknown or other
  misc_feature (535)..(535): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggagggtccctgagactctcctgtgcagcctctgcattcaccttnagtgaccacaacntggactgggtccnccaggctccgagggaacgggctgggagtgggtcggccgtagttacgaaaggaagctaaacaggttaacagtaacagaatacggcgcgtctagagaaaggagttcaccatctacaaganatagaattacgaaagtaactcaactgtaactctagactaaagtcgaaacacgtacctaaggaaaaccgnggaaccacggccgttagtacttagtggtaggtaagaacgtaaaagnggtaggagttcggtagggtaggtgtgtggtacg

SEQ ID NO: 145308 - DNA, 656 bp, Homo sapiens
  misc_feature: GYAE6OF01BSGYJ.21.4.A04.1.454.CMB.1.raw
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggcctcccaggttcccncatctatcgctcgggtcccacgacgggccacgtggcacgtcccagaccgaggttcaggtcggctaggtgggtctgggacaggtacttcacttctacacttctaattacgctaaggacgttaggacgtccgtaaggaaacgtagttttccggactaggttacgttaacgtttacttaggtacgaacgtactaacggtttaacgtaggggttaaaaccgttttcccgtaaccctttccggttacggttacccggtttaccgggaacccggtaaacggggtaaacccgttaaagggtaacgtaaaacgtacggtaaaacgtaacgttagggtacggtcgttacgaccgtaaccctagttccgttacg

SEQ ID NO: 145309 - DNA, 725 bp, Homo sapiens
  misc_feature: GYAE6OF01C58H0.21.4.A04.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanacgccaccctctcctgcagctccagccagaatactccagacgctaactacatacgcctggtaccagcaagaagcctggccaggctcccgaggttcccnatctatcgcgtcgggtcccacgacgggccacgtggccacgtcccaagacgtacggttccaaggttcggacgtagggtcggggtccgtaggggaactacggtacctttaccgaaccttcgtactaacttccgtaagtttaacgcgtaacgtaaccggttacgggtaacggtacccgttaagggtaaacggttacgttttaccgggacgttaagggtttacgtttaacttttacgtacggttaccgtaaggtaccgttaaagggttacgttaacggggttaaaccgttttacccgacccgtttcgttacgggttaccgggtttaccggaaccggtaaaacggggaaccgtaaaacgggttaaagaaaacggttacggaaaaccggtaacgttgggtacggacttacggacctaaccgttagtcgttacg

SEQ ID NO: 145310 - DNA, 502 bp, Homo sapiens
  misc_feature: GYAE6OF01EY248.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgctcgggtcccacgagggccactggcactcccagacaggttcaggtgcagtgggtctgggacagacttcactctcatcattagcagacgtggagccgtagaagtagtttcgctagtgttattactgtcagctagtatggtattcactctgtcgtcggcaagggacaaggtagaatagaaacgactgtagctagacactgtcgtcg

SEQ ID NO: 145311 - DNA, 604 bp, Homo sapiens
  misc_feature: GYAE6OF01EBK6Z.21.4.A04.1.454.CMB.1.raw
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacgttggtccagccgtgggacgggtccctgagactctcctgtgcagcctctgctattccaccttnacgtcgaccacaacatggactgggtcccncgaggcctacgagggaggctggagtggtcgccgtaatacgaaggaagctaacgagttacagtacagtaatcggcgtcgtcgtagtaacgaaaggtacgtcaaccatctacaagtagatagattaacaaacgtaactacactagtatactagaactaaagtacgaaacgacgaccgtaacgaaacccgtaggaccgaccggtacggttagttaacgttagttaggtaacggtaagtaaacgtaaaagggtacggtaggtagttagggttagggtaggtacggtcgtggtaacgg

SEQ ID NO: 145312 - DNA, 582 bp, Homo sapiens
  misc_feature: GYAE6OF01AKO7P.21.4.A04.1.454.CMB.1.raw
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
  modified_base (377)..(377): a, c, t, g, unknown or other
  misc_feature (377)..(377): n is a, c, g, or t
  modified_base (411)..(411): a, c, t, g, unknown or other
  misc_feature (411)..(411): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggggancgccaccctctcctgcacagccagtcagtctatcgctgactggttancctggtaccagcagaatctggccaggctccaggctcctcatttaccgngcatcccaccgagggcccacgtggtctcccgagactaggttcaggtcggcggtggtagtttggggactaggtacgttttcnctccactatcacgccgaccctagagagtgaagtnttgttcgactagttttacttctgccagtactaattattaattacgtggtcctaggtccgttacgtaccggttccggaccgtaacggggaccgtaagggtacggaaactaccgaaaacggtacgtggtacggactcgacctacgacttcgtcgtacttctattccctacccg

SEQ ID NO: 145313 - DNA, 694 bp, Homo sapiens
  misc_feature: GYAE6OF01C3OSA.21.4.A04.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggcaccctgtctttgctccgaaggggaaanacgccaccctctcctgcagctccagccagaatatccaganctaactacatacgcctaggaccagcaagaagcctggccaggcctcccgaggttccnatctatgctcgggtcccacgtagggccaacgtggaccagtccccaagacctagggtttccagggtcgggactagggtgggtcctaggggaacctaggtaaccctttccaactttcctacgaacttacctaagttaacgccgaaggtacgttgggaacgtacccgtaaggtaaagttacttttcggacgtaaggtttacggtttaatttaccgtggttaccaaggtaccgtaaggttaagtacgggtaaacggtttccaaccgtttcgtttacgggttccgttacgggaccccgtaaaaaggggtacccaaaaggggttaacgaaaatacgggtaaaaacccggttacgttagggttacgggtacctacggaaccaacccgttaattcggttaccgg

SEQ ID NO: 145314 - DNA, 583 bp, Homo sapiens
  misc_feature: GYAE6OF01B215T.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggtctcagaaaccaccggagaaattgtgttgacgcagtctccaggcaccctgtctttgtctccaggggaaangccaccctctcctgcagctccagccagaatatccagagctactacatacgcctggtaccagcagaacgcctggccaggcctcccgaggttccctcactctatcgtcctcgggtcccacgcgggcccacgtggcactcccagactaggttcaggtcggcgaggtgggtcgtgggacagtaccttcacttctcactctattagcgtagacgtaggacgtaccgtagaagtacgtttcgagtagttagttactttacgtgtacgagcgtagtagtaggtacgttctaccgttcgtcgttcggttccggaccgtaacgggaaccgtaaagggtaacgtaaagtacggaaacgtacgttaggtacggtcgtacgacacctgtcgtcg

SEQ ID NO: 145315 - DNA, 553 bp, Homo sapiens
  misc_feature: GYAE6OF01EPOHO.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanatccaccctctcctgcagctccagccagaatatccagagctactacatagcctggtaccagcagaagcctggccaggcctccgaggttcctcatctatgctcgggtcccacgagggcccagtcgcactcccagacaggttcaggtggcaggtgggtcgtgggacagacttcactctcatcattacgcagacgtggacgctagaagtatttcgctagtgttattacgtgtacagctaagtagtaggtaacttcctactcgtcggttcgttcggaccgaaacgggtaaccgtaaggtaacgtaaagtacggaaaacgtacgttggtacggtacgtagacctaactagttcgtacg

SEQ ID NO: 145316 - DNA, 599 bp, Homo sapiens
  misc_feature: GYAE6OF01AP1MX.21.4.A04.1.454.CMB.1.raw
  modified_base (512)..(512): a, c, t, g, unknown or other
  misc_feature (512)..(512): n is a, c, g, or t
tcagtcgtcgctcgcacgaccggtgctcgatttagagtagtgatcagggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagcctggagggtccctgagactctcctgtgcagcctctgcattccaccttcagtcgaccacaacagtggacctggggtcccgccaggcctccggaggggaacgggctgggaggtcgggtccggccgtattacgaaaggaaagctaaacgagttacagtaacagaagtacggcgcgtctggtagaaagggtagttccaacatcctacaaagagtatggaactttacgaaaagtacctacgacgttagtaactctagacaaaatgaaacacgacctaaagaaaacccgnggaacccacgggtccgttagtattaacgttgtaggtaagaaacgtaaaggagtaggaagttgggtagggtagtacggtgtggtaccg

SEQ ID NO: 145317 - DNA, 752 bp, Homo sapiens
  misc_feature: GYAE6OF01CIY3F.21.4.A04.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcaccctgtctttgctccgaggggaaancgccacctctcctgcagctcagccaagaatacnccagacgctactacatacgccttaggtaccagacaggaacgcctaggccaggtcctaccgaggtttcccngtactcgtatcggtcgtcgggtacccacgcgggaccctacgtcggaccaacgtaccccgaaggtaccgtaagggtttccgagggttcgggacgtagggttcgggtcgtaggggaacctaacggttaccttcgaaccgttccttaccgaacgttctaacgttacgaccgtaacggtaacgttacgggaactacccggttaaggtaaacgttaccgttttaccggacgttaacggtttacgtttaaaccgtttacgttacggtaaccgtaggttaaccgtaaggtttacggtaacgggttaaaccgttcgtaaccgtttcgggttacggttaccggttaaccgggtaaccggaaaacggggttaccgtaaaagggttaacgtaaagtaacgggtaaacggtacggttacggtacggtaacgtaccggacctaacgtcggtttacgttacgg

SEQ ID NO: 145318 - DNA, 553 bp, Homo sapiens
  misc_feature: GYAE6OF01EU989.21.4.A04.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatagcctggtaccagcagaancctggccaggcctcccgaggttccncatctatgctgggtcccagagggccacgtggcatcccagacaggttcagtgcaggtggtcnggacagacttcacttcnatcattagcagactggagcctagaagtntttcgctagtgtattactgtcagcagttagtggtaacgttcaccttcgtacgttccggttaccgggacctaaacggggaaccgtaaagggtaacgaaagttacggaaaacgtaacgttgggtacggtccttaggacctaaccgtagttcgttacg

SEQ ID NO: 145319 - DNA, 522 bp, Homo sapiens
  misc_feature: GYAE6OF01ELWA4.21.4.A04.1.454.CMB.1.raw
  modified_base (464)..(464): a, c, t, g, unknown or other
  misc_feature (464)..(464): n is a, c, g, or t
  modified_base (497)..(497): a, c, t, g, unknown or other
  misc_feature (497)..(497): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtatgggggagacttggtccagcctggagggtccctgagactctcctgtgcagcctctgcattcaccttcagtgaccacaacatggactgggtccgccaggctccgagggaggggctgggagtgggtcggccgtattacgaaggaagctaacagttacagtacagaatacggcgcgtctgtagaaaggtaggttcaccatctacaagagatgattacaaagactcactgtatctgacaaatgaacagacctagaaaccgngacacggcgtagtattagttgtgtagacaaagngtggatggtggtagtagctggtacg

SEQ ID NO: 145320 - DNA, 582 bp, Homo sapiens
  misc_feature: GYAE6OF01EWS2I.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaaangccaccctntcctgcagctccagccagaatatccagagctactacatacgcctggtaccagcagaagcctggccaggctcccagtttccncatctatgctgggtcccacgacgggccacgtggcactcccgagacaggttcagtggcaggtgggtctgggacagacttcactctcatcattagcagctggacgctagaagtatttcgactagttagtatttacgtgtacagtctaagttagtggtaaagtttccaaccttcgttcggttaccggttacgggacccgtaaaggggtaacccgtaaaaggggttaacgtaaaagttaacggaaaacccgttaaacgttggtacgggtactacggaccctaacctacgttcgttacg

SEQ ID NO: 145321 - DNA, 758 bp, Homo sapiens
  misc_feature: GYAE6OF01DM0BU.21.4.A04.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcaacgaaaccaccggagaaattgtgttgacgcagtctcaggccacctgtctttgtctaccgagggaaagcgcccaccctctcctgcacgctccagaccagaactacnccgagacgactaactacatacgcctacggaccagacaaggaacgccgtcggaccgacggtccctccccgtaggtttccctacgtactccttagtcggaccgttccgggtacccaacggtaccgggccctaacgtcggacctaaccgtccccgaagtaccgtacggttaccagggttcgggacgtacggggttcgggtaccgtagggtaaccgtaacgtaccttacgaacctttcactacgttaccgtaagttaacggctaacggtactagggtaactaccgtaaggtaactagtttaccggacgttaacggtttagttaacgtttacgttgtacgtagtaccgtaaggttagtaaccgggtaaacgtttcccgaaccgtttcggttaccggttacccggttaccgggaaccggtaaacgggttaaacccggtaaagggttaaacgtaaacggtaacgggtaaaccggtacgttacgggacggtacctaagtaacccgtaacgttcgttacgttaccg

SEQ ID NO: 145322 - DNA, 529 bp, Homo sapiens
  misc_feature: GYAE6OF01CXLPX.21.4.A04.1.454.CMB.1.raw
  modified_base (200)..(200): a, c, t, g, unknown or other
  misc_feature (200)..(200): n is a, c, g, or t
  modified_base (357)..(357): a, c, t, g, unknown or other
  misc_feature (357)..(357): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctacacatagcctggtaccagcagaagcctggccaggctcccaggttccctcatctatcgctcgggtcccagacgggccacgtggccactcccagaccaggttcaggtgcaggtggtcngggacagtacttcactctcatctattagcagactggacgcgtagagtatttcgctagtgttacttactgtcagctagtagtaggtaacttcacttcgtgtcgttcggaccgaagggaccgtaaggtaacgaagtacggaaacgtacgtgtacggtctagacactgtcgtacg

SEQ ID NO: 145323 - DNA, 583 bp, Homo sapiens
  misc_feature: GYAE6OF01B2UN0.21.4.A04.1.454.CMB.1.raw
  modified_base (200)..(200): a, c, t, g, unknown or other
  misc_feature (200)..(200): n is a, c, g, or t
  modified_base (350)..(350): a, c, t, g, unknown or other
  misc_feature (350)..(350): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaaangccaccctctcctgcagctccagccagaatatccagagctacacatagcctaggtaccagcagaacgcctggccaggcctcccgaggttcctacgatctagtcgcgtcgggtacccaggcggcctacgtggaccacgtcccgagtaccgnggttacaggtcggactagggtcgggtctaggggactacggtaccttcgacctacgtactatacgtaattacgcaggtactaggacgcgtagaacgtatttcgactagttacttattacgtgtacgagtctagttacgtaggtaacttcgacgttgtgtaccgtcgacgtaacggaccgtaaggtacaagtacggaaacgtagtacggtcgtactacgacctactgttcgtacg

SEQ ID NO: 145324 - DNA, 549 bp, Homo sapiens
  misc_feature: GYAE6OF01CYW9G.21.4.A04.1.454.CMB.1.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaagatccaccctctcctgcagctccagccagaatanccagacnctactacatagcctggaaccagcaagaacgccgtggccaggcctcccgaggttcctcatctatgctcgggtcccagacgggccagtggcactcccagacaggttcagtggctaggtggtcngggacagtactcacttcncatacattagacagtactggacncgtagaagtagttcgatagtagttactttacgtcgtacgagtactaagtagttaggtacgtttcacgttctggtcgtcggaccgaaggactaaggtaagaaatacggtaaaacgacgttaggtcgacgtacgacaactgtcgttacg

SEQ ID NO: 145325 - DNA, 638 bp, Homo sapiens
  misc_feature: GYAE6OF01B6XCK.21.4.A04.1.454.CMB.1.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttgtctccaggggaaangccaccctctcctgcagctccagccagaactatccagagctactacatagcctggtaccagcagaacgcctggccaggcctcccgaggttccncatctatcgcgtcgggtcccacgacgggcccacgtcgggaccacgtccccgaagaccgtaggtttcaggtcgggctagggttcggggtctggggaactaggtacttcactctcatcattagcagacgtggacgtccgtagaacgtactttcgctagttgttaatttacgtgtacgagtcgtagttagtagggtaacgttccgtaaccgttcgttacggttccggttaccgggaccggtaaacgggtaaccggtaaagggttaaacggtaaaagttaacgggtaaaaacccggtaccgttacggtacgggtccgttacggaccctaacccggtaagttccgttaccg

SEQ ID NO: 145326 - DNA, 496 bp, Homo sapiens
  misc_feature: GYAE6OF01AX2D9.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (439)..(439): a, c, t, g, unknown or other
  misc_feature (439)..(439): n is a, c, g, or t
  modified_base (491)..(491): a, c, t, g, unknown or other
  misc_feature (491)..(491): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaantccaccctntcctgcagctccagccagaatatccagagctactacatagcctggtaccagcagaagcctggccaggctcccaggttcctcatctatgctgggtcccacgagggccactggcatcccagacaggttcagtggcagtgggtctgggacagacttcactctcatcattagcagactggagcctagaagtatttcgctagtgtattacgtgtcagctagtatggtaattcactntgtcgttcggcctaagggaccaaggtagaatagaaacgactgtgctgacacntcgtg

SEQ ID NO: 145327 - DNA, 614 bp, Homo sapiens
  misc_feature: GYAE6OF01BZHKX.21.4.A04.1.454.CMB.1.raw
  modified_base (195)..(195): a, c, t, g, unknown or other
  misc_feature (195)..(195): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgttggcatcgacgttgcctggtaaccaacaaaacctggccaggctccagttctcctcatctatggggcatcctacaggatgaccgcactcccagactaggttcagtgcaggtggtctgggacagacttcactctcacatcaacacactgcnctgagtatttgntagtntattactgtacagtagttgtatcgggttacggtaccttaaccggtacgttaccgtttcgggacccggtaaacgggggtaaccctaaggggttcgggaacggtacgtaacggtaaacggacggtaaaccggttgggttaacgggaccgttacggaccctaacccggtgtttaccgttcgtttaccctttacctaacgtttcccccgttcccggttaacccc

SEQ ID NO: 145328 - DNA, 676 bp, Homo sapiens
  misc_feature: GYAE6OF01BGDF6.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatactccagacgctactacatacgcctggtaccagcaaggaacgcctggccaggcctcccgaggttccctcacttctagtcggccgtcgggtaccccagacgggcccacgtcggaccactcccgagaccgtaggttcaggtcggcgtagggttcgggtcgtgggaactaggtaccttcgacttctactatactagttacgcgtaagtacgtaggacgtaccgtaggtaagttacgttacgtacgtagttacgttaacgtttacgttagtacgtaacgtacgtaggttacgttacgggttaacgttaccgtaccgttacggttacggttaccggttaccggggggggacctaaacggggtaaccggtaaagggtaaacggtaaagttaacggtaaaacggtaacgttacggtacggtacgtacgaccgtaccgtacgttcgttccg

SEQ ID NO: 145329 - DNA, 599 bp, Homo sapiens
  misc_feature: GYAE6OF01DRB1L.21.4.A04.1.454.CMB.1.raw
  modified_base (200)..(200): a, c, t, g, unknown or other
  misc_feature (200)..(200): n is a, c, g, or t
  modified_base (446)..(446): a, c, t, g, unknown or other
  misc_feature (446)..(446): n is a, c, g, or t
  modified_base (476)..(476): a, c, t, g, unknown or other
  misc_feature (476)..(476): n is a, c, g, or t
  modified_base (591)..(591): a, c, t, g, unknown or other
  misc_feature (591)..(591): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaaanacgccaccctctcctgcagcctccagccagaatactccagacgcctaactacatacgcctaggtaccagcaagaacgcctggccaggcctccccgaggttccctacattctatcggacctccgggtacccagacgggccctacgtcggaccacgtcccaaggtaccgtaggtttccaaggttcggacgtagggttcgggtcgtaggactacgtacttcactctacatcattagcgtagactggacnccgtagagttattcgatagtacttattcgngtacagtcgtaagttacgtagggtaacttcctacgttcgttcggttaccgttcggacgtaacgggaactaaggtacgaaagtacgaaagtacgtggtacgactacggacaccgtntccgttcg

SEQ ID NO: 145330 - DNA, 693 bp, Homo sapiens
  misc_feature: GYAE6OF01CJ85A.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagagccaccctctcctgcagctccagccagaatactccagacgactactacatacgcctggtaccagcaagaacgcctggccaggcctcccgaggttcctcatctatcgcgtcgggtaccccacgacgggcccacgtcgggaccacgtccccaaggaccgtaggttccaaggttcgggaccgtaggggttcggggtcgtagggggaacctaggtaacctttcgaaccttcctacgtacttaccgtaagtttacggaccgtaacggtaccggttaggggaaccgtaccggtaaggtaacggttacgttttcggacgttaggttacgtttatttacgttaggtacgagtacgtaaggttaaggtagggtaacgttaccgtaccgttcgtcggttaccgttaccgggaccgtaaacgggtaccgtaaagggtaacgtaaagtaacggtaaacgtacggttacggtacggtacctacggactaccgtagttcgtacg

SEQ ID NO: 145331 - DNA, 569 bp, Homo sapiens
  misc_feature: GYAE6OF01A94FD.21.4.A04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaaangccaccctctcctgcagctccagccagaatatccagagctactacatagcctggtaccagcagaagcctggccaggctcccaggttccnatctatgctgggtcccacgacggccactcggcactcccgagacgtaggttcaggtcggctaggtcgggtctggggacagtacttcacttctcatctattacgacagtacgtggacgtcctaggaagtacgtttacgcgtagttagttactttacgtgtacgagtacgtagtagtaggtaagttcctacttcgtcgtcggttcgaccgtaagggtaaccgtaagggtacgtaaagtacggaaacgtacgtaggtacggtacgtagacctacgtgtcgttacg

SEQ ID NO: 145332 - DNA, 597 bp, Homo sapiens
  misc_feature: GYAE6OF01BGEZ5.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatacgcctggtaccagcagaagcctggccaggcctcccgaggttccctcactctatgcgtcgggtcccacgacgggcccacgtggccactcccgagaccgtaggttcaggtcggctaggtcgggtctggggactacggacttcgactctactatctattacgctagacgtggacgcctagaacgtactttcgactagttgttaacttacgtgtacagtactaaggtagtagggtaacgttcgtaccttcgttcggttacggttccggaccgtaaacgggtaaccgtaaagggtaacgtaaagtacggaaaccgtacgtggtacgtacgtacgaccaccgtagtccgttacg

SEQ ID NO: 145333 - DNA, 601 bp, Homo sapiens
  misc_feature: GYAE6OF01ARZC7.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttccncatctatgctgggtcccagacgggccacgtggccactcccgagacaggttccaggtggcaggtcgggtctgggacagacttcactctcatctattacgcagtactggacgccgtagaacgtatttccgacgtagttgttaatttacgttgtactaggtctaaggttacgttacgggtaacgtttcctaaccttcgttacggttcggttaccggaccgtaaacgggaacccgtaaagggttaacgtaaacgttaacggaaaaccggtaacgttggttacgggacttacggacctaaccgtacgttcgttacg

SEQ ID NO: 145334 - DNA, 874 bp, Homo sapiens
  misc_feature: GYAE6OF01AVH9T.21.4.A04.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagctccagccagaatatccagagctactacatacgcctggtaccagcagaacgcctggccaggcctcccgaggttcccncatctatcgcgtcgggtcccacgacgggcccacgtcggccactccccgaaggaccgtagggtttccaagggttcgggaccgtagggttcgggggttccgtacgggggaacctacggtacctttccgaacctttcctaccgtaatttaccgtaagtttaacggaccgtaacgggtaaccgttacggggaacgttaccccggttaagggtaaacggttaacgttttttacccgggaccgtttaaacgggttttacggtttaaacctttttaaccggtttacggtttacccgtaacgggttaaccgttaagggttttaaacgggtttaacgggggttaaacggttttaccccgttaaaccccggttttccggtttaccggggtttacccggggttttaacccgggggtaaccccgggttaaaaacccgggggggttaaaccccggttaaaaaggggggttaaaccgggtaaaaaacggtttaaacggggtaaaaaacccgggttaaaccggtttcggggttaaccggggtacccgttaacgggtaaccccgtaaaccccgttaagtttcccggtttaccgg

SEQ ID NO: 145335 - DNA, 700 bp, Homo sapiens
  misc_feature: GYAE6OF01BFTRW.21.4.A04.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaaangccaccctctcctgcagctccagccaagaatanccagacgctactacatagcctggtaccagcagagcctggccaggcctcccgaggttcctacgatctagtcgcgtcgggtcccagacgggcccacgtcgggccacgtccccaaggaccgtaggttacaggtcgggccgtagggttcgggtacgtggggaactacggtaccttcctaaccgttcctactaacttaccgtaagttacggacgaacggtacgtgggaacgtaccgtaggtaaacgttacgtttacgacgtacggtttagttaacgtttacgttggtacgtacgtacgtaagttacggtagggttaacgttaccgttaacccgttccgttacgggtttaccggttaccgggtaccggtaaaccgggtaaaccgtaaacgggtaaacggtaaacggtaacggaaaaaccggttacgtacgggttacggtacgttacggaaccgtaaccgttacgttcgttacg

SEQ ID NO: 145336 - DNA, 506 bp, Homo sapiens
  misc_feature: GYAE6OF01AZKCG.21.4.A04.1.454.CMB.1.raw
  modified_base (200)..(200): a, c, t, g, unknown or other
  misc_feature (200)..(200): n is a, c, g, or t
  modified_base (405)..(405): a, c, t, g, unknown or other
  misc_feature (405)..(405): n is a, c, g, or t
  modified_base (449)..(449): a, c, t, g, unknown or other
  misc_feature (449)..(449): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctcgggtcccacgagggcccactggccatccccagaccaggttcaggtggcaggtgggtctggggacagacttcactctcatcattagcagactggagcctagaagtntttcgctagtgtattactgtacagcaagtatggtaattcacttntgtcgttcggcaagggaccaaggtacaaataggaaacgactgngctgacacntctcg

SEQ ID NO: 145337 - DNA, 576 bp, Homo sapiens
  misc_feature: GYAE6OF01B4057.21.4.A04.1.454.CMB.1.raw
  modified_base (390)..(390): a, c, t, g, unknown or other
  misc_feature (390)..(390): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtcccgccagggctccgaggggaagggctgggaggtgggcggccgtataacgaaggaaacgctaaacgagttacagtacagaatacggcgcgtngtagaaagaggtcacatctacgaagagatagattacaaagactcaactgtaatctagactaaatcgaaacacgacctaaggaaaaccgagggaccacgggaccgttagtaagtttagtaggtaggtaaagaaacgaaaaggtaggttaagggattagggtagggtagggttaacgtcgtggtaacg

SEQ ID NO: 145338 - DNA, 556 bp, Homo sapiens
  misc_feature: GYAE6OF01DU1WU.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttcctcatctatgctgggtcccagcgggccacgtggcactcccagacaggttcagtgcgagtgggtctgggacagacttcactctacatcattagcagactggacgcctagaagtatttcgctagtgttattacgtgtcagctagtatgggtaattccacgttcgtcggttccggttccggaccgtaaacgggtacctaaagggttaacgaaaagttacggaaaaccgtaacgtaggttacggtacttaggaccctaacctgttccgttacgg

SEQ ID NO: 145339 - DNA, 535 bp, Homo sapiens
  misc_feature: GYAE6OF01BLXR5.21.4.A04.1.454.CMB.1.raw
  modified_base (201)..(201): a, c, t, g, unknown or other
  misc_feature (201)..(201): n is a, c, g, or t
  modified_base (370)..(370): a, c, t, g, unknown or other
  misc_feature (370)..(370): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacctgagaaattgtgttgacgcagtctccaggcaccctgtctttgtctccgaggggaaangccaccctctcctgcagctccagccagaatatccagagctactacatagcctggtaccagcagaagcctggccaggcctcccgaggttcctcattctatcgctcgggtcccacgacgggccactggccactcccagacgtaggttcagtggcaggtgggtcgtgggacnggtacttcactctcatcattagcagacgtggagtccgtagaagtagtttcgctagtgttattctgtcagctagtagtggtacgttctactctgtccggttcggaccgaagggacctaagggtaagaaagtacgaaacgtactcggtacggctacgcaccgtgtcg

SEQ ID NO: 145340 - DNA, 566 bp, Homo sapiens
  misc_feature: GYAE6OF01D02TL.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (430)..(430): a, c, t, g, unknown or other
  misc_feature (430)..(430): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaangccaccctntcctgcagctccagccagaatactccagagctactacatagcctgtaccagcagaagcctcggccacggctcccgtacggttcctcatcctatcgcgtcgggtcccacgacgggcaccccccgtggccactcccgagacgtaggttcaggtggcgaggtggtcgtgggacagtacttcactctctatcattagcgagacgtggacgcgtaggaagtagttcgntacgtagttattactgtacgagtcagtagtaggtaagttcacgtcgtgtcgttacggacgaagggtaaccgaaggtaacgaaagtacggaaacgtaacgttagggtacgtacgtacgaccgtaccagttcgttacg

SEQ ID NO: 145341 - DNA, 589 bp, Homo sapiens
  misc_feature: GYAE6OF01CR8LR.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagctccagccagaatatccagagctactacatagcctggtaccagcagaacgcctggccaggcctcccgaggttcctcatctatgctcgggtcccagacgggccacgtggcactcccagactggttcaggtggcaggtgggtctgggacagtacttcacttcacatacattagacagacgtggacgtccgtagaagtagtttcgcgtagtgttactttacgtgtacgagtacgtagttagtaggtacgttcctaccttcgttcggttccggttaccggacccgtaaacgggtacccgtaaagggttaaacgtaaagtaacggaaaaccggtacgttaggtacggtactacggacctaaccgtgttccgttacg

SEQ ID NO: 145342 - DNA, 571 bp, Homo sapiens
  misc_feature: GYAE6OF01A0ED0.21.4.A04.1.454.CMB.1.raw
  modified_base (350)..(350): a, c, t, g, unknown or other
  misc_feature (350)..(350): n is a, c, g, or t
  modified_base (483)..(483): a, c, t, g, unknown or other
  misc_feature (483)..(483): n is a, c, g, or t
  modified_base (523)..(523): a, c, t, g, unknown or other
  misc_feature (523)..(523): n is a, c, g, or t
  modified_base (560)..(560): a, c, t, g, unknown or other
  misc_feature (560)..(560): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccgccaggcctccgagggaagggctgggagtgggtcgcgtatacgaaggaanctaacagttacagtacagaatacggcgcgtctgtaggaaaggaggttccaccatctacaaaggagatagaattacaaaagtacctcaactgtaactcagacaaaatgaaaccagtaccctaaggaaaacccgnggaaccaccgggtcttagttaattagttggaacgggtaanaaacgaaaaggtggtaggagttgggtagggtaggtancggttgtaacg

SEQ ID NO: 145343 - DNA, 743 bp, Homo sapiens
  misc_feature: GYAE6OF01CMDI2.21.4.A04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccaccctctcctgcagctccagccagaatactccagagctaactacatagcctaggtaccagcagaacgcctggccaggctcccgaggttccncatctatcgctcgggtccccagacgggccacgtggaccactccccgaagaccgtagggtttaccaggttcgggacctaaggggttcggggtaccgtagggggaacctacgggttaaccctttccgaacctttccgtaccgtaacttaccgtaacgtttaacggaccgtaacggtaccgttagggaacggtacccgttaagggtaaacgttacgtttttccggacgttaaggtttacgtttaactttaaccgtggttacccgaaggtaccgtaaaggttacgttacggggttaacgtttccgtaacccgtttcgttacgggttcccggtttacccgggaaccccggtaaaagggggtaaccctaaaaggggttaacgtaaaacggttacggtaaaaaccggtacgttagggttacgggtactacggacctaacccgtagttccgttacgg

SEQ ID NO: 145344 - DNA, 761 bp, Homo sapiens
  misc_feature: GYAE6OF01B3FKB.21.4.A04.1.454.CMB.1.raw
  modified_base (191)..(191): a, c, t, g, unknown or other
  misc_feature (191)..(191): n is a, c, g, or t
tcagtcgtcgctcgcacgaccggtgctcgatttagagtagtgatcaggggagagctgctcagttaggacccagagggaaccatggaaacccagcgcagcttctcttcctctgctactctggctcccaggctcagaaaccacggagaaattgtgttgacgcagtctcaggcacctgtcttgctcgagggaancgccacctctctgcacgctccagaccaagaactactccaagacgctaactacatacggcctaggtaaccagacgaaggaacgtccgtaggacccgacgggtccctaccccgtacggtttccctactaacttaccttagtcggtcccgttaccggggtaccccaacggtaccggggtcccaaccggttcgggaccctaaccgttaccccgaaggtaccgtaagggtttcaaggggttcggacgtagggtcgggtcgtacggggaacctacggtacctttcgaacttccgtacgtaactacgtaagttacgacgtaacggtacgttagggaccgtaccgtaaggtaacgttacgtttacggacgttaggttacgttaacttacgttcgtacgtaacggtcgttaaggttagttaacgggttaacttacccgtacgttcgttacgggttccggttaccggaaccgggttaaacgggaaaccggttaaagggtaaacgtaaaaggtaaccggtaaaccggtaacggttacgggtacggtaccgttacggaaccctaacgttacgttcgttaccg

SEQ ID NO: 145345 - DNA, 542 bp, Homo sapiens
  misc_feature: GYAE6OF01AGNW0.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggtctcagaaaccaccggagtaaattgtgttgacgtacagtctccaggcaccctgtctttgtctccgaggggaaangccaccctctcctgcagctccgagccagaatatccagagctactacatagcctggtaccagcagaacgcctggccaggcctcccgaggttccctcactcgtatcgcgtcgggtcccacgacgggtcctacgtggcacttcccgagtaccaggtttcacggtggctaggtcgggtcgtaggggacagtacttcactctcatcattacgctagactggacgtctagaacgtatttcgactagtgtattacgtgtcagcagtagtggtattctactcgtgtcgttcgcgaaggaccgaaggtacgaagtacgaacgtacgtgtcgctgacactgtcgtcg

SEQ ID NO: 145346 - DNA, 713 bp, Homo sapiens
  misc_feature: GYAE6OF01EFKPL.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagcctccagccagaatactccagagtctaactacatacgccttggaaccagcaagaacgccgtggaccaggcctccccgaggtttccctactattcgtatcgccgttcgggtacccacggacgggccagtcggcctacgtcccgagaccgtaggttcaggtcggcgtagggtcgggtcgtgggactacggtacttcacttctctatctagttacgcgtagtacgtggacgtccttaggaacttacgttttcgacgttaggtttacgttaacgtttacgtggttaccaggtaccgttaaggttaacggtttaacggggttaacttttacccgtaccccgtttaggtttccgggtttacccgggttaacccgggaaacccgggttaaaacgggggtaaacccgttaaaggggtaaaacggttaaaacggtaacgggtaaaaccggtaaacgttcgggtacgggtacttaacggaccttaaccgtcgtttccgttacgg

SEQ ID NO: 145347 - DNA, 510 bp, Homo sapiens
  misc_feature: GYAE6OF01A8OH1.21.4.A04.1.454.CMB.1.raw
  modified_base (200)..(200): a, c, t, g, unknown or other
  misc_feature (200)..(200): n is a, c, g, or t
  modified_base (505)..(505): a, c, t, g, unknown or other
  misc_feature (505)..(505): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttccctcatctatgctgggtcccacgacgggcccacgtggccactcccgagacaggttcagtggcaggtggtctgggacagtacttcactctcatcattagcagacgtggacgcctagaagtatttcgctagtgttattactgtcagctagtatgtattcactcgtgtcgtcggaccgtaaggaccaaggtagaataggaaacgactgagctagacactntcgtg

SEQ ID NO: 145348 - DNA, 766 bp, Homo sapiens
  misc_feature: GYAE6OF01DA0H8.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtcctccaggcaccctgtctttgtctccgaggggaaagacgccaccctctcctgcagcctccagccagaatactccaagagctaactacatacgtcctggtaccagcaagaacgccgtaggccaggcctcccgtaggttccctactattcgtagtcggccgtcggggtccccaacggacgggaccctacgtcggccaaccgtccccgaaggaacctagggtttccgaaggttcgggaccgtaggggttcgggtcgtacgggggaacacgggttaaccttccgtaaccttcctacgtaactacctaacgtttaacggacctaacgggtaacgttacgggaacgttacccggttaaggtaaacggttacgttttacggaccgttaaggttacgttttaacgttttacgtacggttacgtaacggtacgtaaggtttaacgttaaggggttaactttacccgtaaccgtttcggttcggttaccgggtttacccgggaaccggtaaacggggtaacctaaaggggttaaacggaaaaggttaaacggtaaaaccgtaacgttagggtacggtacgttaacggacctaacctagttccgttacgg

SEQ ID NO: 145349 - DNA, 804 bp, Homo sapiens
  misc_feature: GYAE6OF01D997J.21.4.A04.1.454.CMB.1.raw
  modified_base (200)..(200): a, c, t, g, unknown or other
  misc_feature (200)..(200): n is a, c, g, or t
  modified_base (300)..(300): a, c, t, g, unknown or other
  misc_feature (300)..(300): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgtctcgaaggggaaancgccaccctctcctgcagcctccagccaagaatactccaagagctaactacatacgcctaggaccagcaagaacgcctggccagcctccgaggttccctnatctagtcgcgtcggtacccacggacggcctacgtcggacctacgtcccgaagtaccgtaggttccgaggtcgggactagggtcggtacgtgggaactagtaccttcgacttcgtactaacttacgtaagttacgacgtaacggtacgtagggaccgtaccgttaaggtaaacgttacgttttaccggacgttaagggtttacgttaacgttttaccgtacggttaccgtaaggtaaccgttaaggttaacggttaaccggggttaaaccgtttaccccgttaacccgttttaccgggttaccgggttttacccggggttaacccgggtaaacccgggttaaaaccggggtaaaacccggttaaaagggggttaaaaaccggtttaaaaacgggttaaacccgggttaaaaaacccgggttaaaccggtttaggggttaacccgggttaccgttaacccggaacccgttaaacccggtttaaccgtttcccggtttaaacccgg

SEQ ID NO: 145350 - DNA, 568 bp, Homo sapiens
  misc_feature: GYAE6OF01CDQNL.21.4.A04.1.454.CMB.1.raw
  modified_base (560)..(560): a, c, t, g, unknown or other
  misc_feature (560)..(560): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcacgcctctgcattccaccttcagtcgaccacaacatcggactcggggtcccgccgaggcctaccgaggggaaggggctgggaggtgggtcggccgtattaacgaaggaagctaaacagttaacagtaacagaagtcggcgtcgtcgtgtaggaaaggaaggttcacatctacaagagatgattacaaagtactcactgtatctagacaaatagaacagacctaagaaacgagacacggccgtagtattagttggtaggtaagaacgtaaaaggacggtaggtacgtggttagggtaggtacgngtggtacg

SEQ ID NO: 145351 - DNA, 693 bp, Homo sapiens
  misc_feature: GYAE6OF01CIUIX.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaaggggaaancgcccaccctctcctgcagcctccagccagaatactccagagctactacatacgcctggtaccagcagaacgcctggccaggcctcccgaggttccctcactctatcgccgtcgggtcccacgacggccacgtggccactcccgaagacgtcggttcgaggtcggcgagggttcgggtctgggaacagtaccttcactctacatctaagttacgctaagacgtaggacgtaccgtagtaacgttacgtttaccggacgttaggttacgttaacgtttaccgttagtaccgtaaggtccgttaaaggttacgttaacggggttaaacgttttacccgtaaccgtttcgtttccgggttacccgggtttaccgggaacccggtaaaacggggtaacccgttaaagggtaaacggtaaaaggtaaacggtaaaaccggtaacggttacggttacgggtaccgttacggaccctaaccgttacgttccgttacg

SEQ ID NO: 145352 - DNA, 591 bp, Homo sapiens
  misc_feature: GYAE6OF01CZANR.21.4.A04.1.454.CMB.1.raw
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattccaccttcagtgaccanaacatggactgggtccncaggctccgagggaagggctggagtgggcgcgtatacaaaggaaagctaaacagttacagtacaagaatacggcgcgtctaggtaggaaaaggaggttcaaccgatctacgaaagagaatagtaattaacaaaacgaactacaacttagtaattctagacaaatacgaactaacgacctaaggaaaaccgacggaacgaaccgggtccgtagttaattagttaggtagggtaaagaaacgaaaaaggtaggtaggaagttgggtagggttaggtagtcgtgtaaccg

SEQ ID NO: 145353 - DNA, 526 bp, Homo sapiens
  misc_feature: GYAE6OF01DOWRN.21.4.A04.1.454.CMB.1.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (456)..(456): a, c, t, g, unknown or other
  misc_feature (456)..(456): n is a, c, g, or t
  modified_base (518)..(518): a, c, t, g, unknown or other
  misc_feature (518)..(518): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtcccagcctgggagggtccctgagactctcctgtgcagcctctgcattcaccttcagtcgaccacaacatggactgggtccncaggctcgagggagggctggagtggcgcgtatacgaaggaanctaacngttacagtacagaatacggcgcgtctgtagaaggagttcacatctanaagngatagattacaaagtactcactgtatctgacaaatgaacagtcctagaaaccgngacgacggcgtagtattagtggtaggtaagaacgaaaagtggtaggattggtaggtggtacngtggtacg

SEQ ID NO: 145354 - DNA, 612 bp, Homo sapiens
  misc_feature: GYAE6OF01DDXUK.21.4.A04.1.454.CMB.1.raw
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacgttggtccagccgtggaggggtccctgagactctcctgtgcagcctctgctattccaccttcagtcgaccacaacatggactgggtcccgcaggctccgagggagggctggagtgggtcgcgtatacaaggaanctaaacngttacagtaacagaatcggcncgtntgagaaggaaggttcacaggtctacgaagagatagattacgaaagtaacctacacttagtatactagaactaaatacgaaactacgacctaacgaaaaccggaggaaccgaaccgggtacccgttaggtaactttaaggttaggttaacggtaaggtaaacgaaaaagggtaggttaggggtaagtttgggttaggggttagggttaaacggcgtttgggtaaccgg

SEQ ID NO: 145355 - DNA, 628 bp, Homo sapiens
  misc_feature: GYAE6OF01CIKC2.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtcccaggcctgggagggtcccctggagactctcctgtgcagcctctgcattccaccttcagtcgaccaacaacagtggacgtgggtcccgccaggcctccggaggggaacgggcgtgggagtggggtccggaccgtagtaacgaaggaaacgactaacgagttacagtacaagaactacgggcgtcgtactgtaggaaagggaacggtttaccaacctagtacctacaagagtaatagattacaaaagtaactactaactgtaatcgtagacaaagtacgaacacgtaccgtaacgaaaaccgagggaccaacgggtccgtagttaacttagttaggttaggtaaggaaacggaaaaaggtaggtaggtagttagggttagggttagggtaagtcgtaggtacg

SEQ ID NO: 145356 - DNA, 686 bp, Homo sapiens
  misc_feature: GYAE6OF01CJIV6.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagcctccagccagaatactccagagctactacatagcctggtaccagcaagaacgcctggccaggcctcccgaggttccctacactctatcgcgtcgggtcccacgacgggccacgtggcactcccagactaggttcaggtggctaggtggtctgggacagtacttcactctacatctattagcaagtacgtggacgtaccgtagtaacgtatttccggacgttagttacggttaactttacgtacgttactaacggtaccgtaaggtttacgttacgggttaaaccgtttccgttaacccgtttccggttacgggtttacccgggtttacccgggaaccgggtaaaaccggggtaaaccggttaaaacggggttaaacggtaaaaacgttaacgggtaaaaaccggtaacggttacgggtacgggttacccgtacggacccgtaaacccgttagttcccgttaaccgg

SEQ ID NO: 145357 - DNA, 884 bp, Homo sapiens
  misc_feature: GYAE6OF01B2W11.21.4.A04.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaggggaaancgccacctctcctgcagctccagccagaatacnccaagagctaactacatacgccttaggtaaccaggccaaggaaacgcccgtagggacccaacggggtcccttaccccgtaagggttttcccctactaactttccgttaagttcggtacccgttcggggtacccccaacggacggggcccctaacgttcgggaccctaacgttacccccgaaggtaaccgtaagggtttaccgaagggttcggggactaacggggtttcgggggtacctggggtaacctaacgggtaccttttccgaaacctttccgttacgtaacgttacgtaacgtttaacggaccgtaaggaaccgttacgggaaccggtacccgttaaggtaaacgttacgttttaccggacgtttaaacggtttacgtttaacgtttacggtttacgtaaccgtaacggtaccggttaaaggttaacggtttacgggttaaacgtttacccgttaaacccgtttccggtttacgggttaaccccgggttttaaccgggaacccgggttaaaacgggggtaaacccgttaaaacgggggtttaaaaccggttaaaaaggttaaacggggtaaaaaaccggttaccggttaagggttaccgggtaaccgttacggaccgttaacccgttaaagtttccggtttaaccgg

SEQ ID NO: 145358 - DNA, 513 bp, Homo sapiens
  misc_feature: GYAE6OF01C445M.21.4.A04.1.454.CMB.1.raw
  modified_base (200)..(200): a, c, t, g, unknown or other
  misc_feature (200)..(200): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
  modified_base (496)..(496): a, c, t, g, unknown or other
  misc_feature (496)..(496): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctaactacatagcctggtaccagcagaagcctggccaggctccccaggttcctcatctatgcgtcgggtcccagacgggccacgtggcatcccagacaggttcagtggcagtgggtctgggacngacttcactcnatcattagcagacgtgacgctagaagtntttcgctagtgttattacgtgtcagtcagtagtggtaacttcaccttgttgtcgttcggaccgaagggaccaaggtagaaatggaaacgacgtgnggtcagcactgtcgtcg

SEQ ID NO: 145359 - DNA, 671 bp, Homo sapiens
  misc_feature: GYAE6OF01DL09M.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgcccaccctctcctgcagctccagccaagaatatccaagagctaactacatacgcctggtaccagcaagaacgcctggccaggcctcccaggttcctcatctatcgctcgggtacccacgacgggcccacgtggacacgtccccagaccaggttcaggtggcaggtggtcgtgggactagacttcacgttctcaactacgaattacgacgaacggtacgttagggaacgtcccgttaaggtaaacggtaacgttttccggaccgttaaggttacgtttaacgttttaaccgttaggttaccgaaggtccgtaaggttaacggttagggtaaaccgtttcctaaccgttcgttacgggttccggtttaccgggaacccgaaaacgggtaacccgaaagggtaacgtaaaagtaacggaaaaaccgtaacggtaggtacgggtaccgtacgaccaaccgtagttccgttacg

SEQ ID NO: 145360 - DNA, 606 bp, Homo sapiens
  misc_feature: GYAE6OF01AGBKA.21.4.A04.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgagggggaaanagcccaccctctcctgcagcctccagccaagaatanccagagctactacatacgcctaggtaccagcagaacgcctggccaggcctcccgaggttccctcacttcatcgcgtcgggtccccacgacgggcccacgtggccacgtcccagactaggttcaggtggctaggtcgggtctgggacagacctttcactctanatctattagcagacgtgganccgtagtaacgtagttcgagtagtgttattactgtacagtacgtagttagtaggttaaccgttcctacgttcgtacggttccggttaccggaccggaaagggtaaccgtaaaggggtacgaaaagttacggaaaaccggttacgttgggtaacggtccgttacgaccctaccgttagtccgttacg

SEQ ID NO: 145361 - DNA, 584 bp, Homo sapiens
  misc_feature: GYAE6OF01DKHY8.21.4.A04.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaangccacctctcctgcagctccagccagaatatccagacgctactacatagcctggtaccagcagaagcctggccaggctccaggttccncatctatgccgtgggtcccagacgggccacgtggcactcccaagactaggttcaggtcggcaggtgggtctagggacaggtactttcacttctactactctattagcaggtaaccgtgggacaccgtagaagtactttcgactagttgttaatttacgtgtacagtactaggtagtagggtaacttaccaccttcgtcgttccggttaccggaccggtaaacgggaccgtaaagggttaaagaaagttacggaaaacgtacgttaggtacggacctacggaccaaccgtgttcgttacg

SEQ ID NO: 145362 - DNA, 565 bp, Homo sapiens
  misc_feature: GYAE6OF01CNE8V.21.4.A04.1.454.CMB.1.raw
  modified_base (201)..(201): a, c, t, g, unknown or other
  misc_feature (201)..(201): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagcctccagccagaatatccagagctactacatagcctggtaccagcagaacgcctggccaggcctcccaggttccctcatctatcgctcgggtcccagcgggccacgtggcactcccagaccaggttcaggtggcaggtgggtctgggacagtaccttcacttctcatcattagctagactggagcctagaagtnttcgntagtgtacttactgtcagtcaagttagtaggtagttccacgttcgttcggtccgttacgggaccgtaaacgggtaccgtaaagggtaacgaaagttacggaaaacgtacgttaggtacggtacgtacgtaccaaccgtgttccgttcg

SEQ ID NO: 145363 - DNA, 536 bp, Homo sapiens
  misc_feature: GYAE6OF01ET2BB.21.4.A04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangcccaccctctcctgcagcctccagccagaatatccagagctactacatacgcctggtaccagcagaagcctggccaggcctcccgaggttccncatctatcgctcgggtcccagacgggccacgtggcactcccagacaggttcagtggcaggtggtctgggacagacttcactctcatcattagctagacgtggacgccgtagaagtatttcgctagtgtattacgtgtcagctagtatggtaattccacttcgtcgtccggttcggacgaaacgggacctaagggtaagaaagtacggaaacgacgtggtacggtctacgaccacctgtctcg

SEQ ID NO: 145364 - DNA, 635 bp, Homo sapiens
  misc_feature: GYAE6OF01AWTDM.21.4.A04.1.454.CMB.1.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgtctccaggggaaancgccaccctctcctgcagctccagccagaatatccagagctactacatagcctggtaccagcagaagcctggccaggcctcccaggttccncatctatcgctcgggtcccacgacgggccacgtggcactcccagactaggttcaggtggacaggtcgggtctgggactagtacttcactctcatcattagcagactggacgcgtagaagtacgtttcggactaggttagttaacttacgttgtaccaagtacgtaaggttaacgtacgggtaacgtttccgtaacccgttcgttacggttaccggttaccggggtaacccgtaaaacgggggtaacccgtaaaaggggttaacgtaaaacgttacgggtaaaaaccggtaacgttagggtaacgggtaccttacggaacccgtaaccgtaagtttcccgttaccgg

SEQ ID NO: 145365 - DNA, 613 bp, Homo sapiens
  misc_feature: GYAE6OF01A9DG0.21.4.A04.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtgaccacaacatggactgggtcccnccaggctccgaggggaagggctgggagtgggtcggccgtattacgaaaggaagctaaacagttacaagtacagaatacggcgcgtctgtaggaaaggtaggttcaccatctacaaagagatgaattacaaagtactcaattgtaactctagacaaatacgaacagaccctaacgggaaaaacccgtagggacccaaccgggtccgttaaggtaatttaaacggtttgggtaacgggttaaagaaaccgtaaaaagggtacggttaagggaagtttgggttaggggttagggtaagtcggttggtaaccgg

SEQ ID NO: 145366 - DNA, 504 bp, Homo sapiens
  misc_feature: GYAE6OF01BYDY8.21.4.A04.1.454.CMB.1.raw
  modified_base (201)..(201): a, c, t, g, unknown or other
  misc_feature (201)..(201): n is a, c, g, or t
  modified_base (498)..(498): a, c, t, g, unknown or other
  misc_feature (498)..(498): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccagggggaaangccaccctctcctgcagctccagccagaatatccagagctactacatagcctggtaccagcagaagcctggccaggcctcccaggttcctcatctatgctgggtcccacgagggccacgtggcactcccagacaggttcagtggcaggtgggtctgggacagacttcactctcatcattagcagactggagcctagaagtatttcgctagtgtattactgtcagctagtatggtaattcactgtgtcgttcggacgaagggacaaggtagaatggaaacgacgtgagctagacactntcgtcg

SEQ ID NO: 145367 - DNA, 725 bp, Homo sapiens
  misc_feature: GYAE6OF01BEURO.21.4.A04.1.454.CMB.1.raw
  modified_base (313)..(313): a, c, t, g, unknown or other
  misc_feature (313)..(313): n is a, c, g, or t
  modified_base (363)..(363): a, c, t, g, unknown or other
  misc_feature (363)..(363): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggccgtgggacggggtccctgacgacctctcctgtgcacgcctctgctattccaccttcagtcaccacaacatggactcgggtccnccgaggcctccgaggggagggctgggagtgggcgacgtatacgaaggaanctaacagttacagtaacagaacgtacggcgtcgtcgtaggtaggtaaagggtacggttaccaacctagtacctaacgaaaggtacgaattaggtaactttaacgaaaaggtaacccttacaaacgttgtaacttacgtaaggtaacctaaaagttaccggaaaccgtaaccggtaacccgtaaacgggaaaaaaccccggtaggggaacccgaacccggggttaccggtttaagttaagttttaacggtttacggggtaaacggggttaaaacggaaaaccggttaaaaaagggtcgggttaaggggtaacgttttaggggggtacgggtttaaggggttaacgtcggttcgggttaaacgg

SEQ ID NO: 145368 - DNA, 641 bp, Homo sapiens
  misc_feature: GYAE6OF01DGANL.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctctcctgcagctccagccagaatatccagagctactacatagcctggtaccagcagaacgcctggccaggcctcccaggttcctcatctatgcctgggtcccagacgggccactggcactcccagactggttcagtggcaggtggtctggacagtactcacttctcatcattagcagactggacgccgtaggaacgtacgtttccgacgtaggttcgttaacgttttacgtcgttacgtaacggtcgtaaggtttaagtagggttaacgtttcccgtaacccgtttcgttacgggttaccggtttacccgggaacccgtaaacgggggtacccgtaaaacggggttaaacggtaaaaggttacggtaaaaaccggtaacggtttagggttacggtaccggttaacggacctaaacccgtagtttcgttaaccgg

SEQ ID NO: 145369 - DNA, 530 bp, Homo sapiens
  misc_feature: GYAE6OF01AUPT8.21.4.A04.1.454.CMB.1.raw
  modified_base (308)..(308): a, c, t, g, unknown or other
  misc_feature (308)..(308): n is a, c, g, or t
  modified_base (394)..(394): a, c, t, g, unknown or other
  misc_feature (394)..(394): n is a, c, g, or t
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
tcagtcgtcgctcgcacgaccggtgctcgatttagagtagtgatcaggggagctctgagagcggagccccagccccagaattcccaggtgttttcatttcggtgatcagcactgaacacagaggactcaccatggagtttgggctgagctgggttttccttgttgttattttacaaggtgtccagtgtgaggtgcagctggtggagtcgtgggggagacttgggtccagcctgggagggtccctgagactctcctgtgcagccctctgcattcaccttcagtgaccacaacagtggactggggtcccnccaggcctccgagggaacggggctgggagtgggtcggccgtattacgaaaggaagctaaacagttaacagtaacagaatacgggcncgtctgtagaaaggaggttcaccatctacaaagagatgaattcaaaagactacactgtatctagacaaatgaacagcctagaaaccgngacacggctntatntgngtaganaaagngtggatggtggngagntgtg

SEQ ID NO: 145370 - DNA, 632 bp, Homo sapiens
  misc_feature: GYAE6OF01AOQUS.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctccaggggaaangccacctctcctgcagctccagccagaatatccagagctactacatagcctggtaccagcagaacgcctggccagggcctcccgaggttccctcatctatcgcctcggggtacccacgacgggcccacgtcggcctactccccgaaggtacctagggtttccaaggttcgggcctagggttcgggtcctaggggaaccaggtacctttcgaccttcgtacatctattacgctaagacgtaggacgtccgtaggaacgtacgtttacgacgtagttacgttaactttacgtgtacaagtcgtaagttagtagggtaacgttcctaccgttcgttcgttccggttccggaccgtaaacgggtacccgtaaagggtaacgaaagttacggaaaaccgtacgtggtacggtactacggacctaccgtagttcgttacg

SEQ ID NO: 145371 - DNA, 644 bp, Homo sapiens
  misc_feature: GYAE6OF01CBNIG.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccagggggaaanacgccaccctctcctgcagctccagccagaatatccagacgctacacatacgcctaggtaccagcagaagcctggccaggcctcccaggttcctcatctatcgcgtcgggtcccagacgggcccaacgtggaccagtcccagacaggtttcagtggctaggtcgggtctagggacagtactttcgactctacgactcattacgcagacgtggacgccgtagaacgtgtttcgacgtagttgtatttcgtagtactagactagttaacgtagggtaacgttccgttaaccttacggttcggttaccgggtttaccggacccggtaaaaccggggtaaccggttaaacggggttaaacgtaaaaggttacggtaaaaaccgggttacgttaacgggttacgggtacccgttaacggtacccgtaacccgtagttcccgttaccgg

SEQ ID NO: 145372 - DNA, 793 bp, Homo sapiens
  misc_feature: GYAE6OF01DB5TD.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcacctgtctttgtctcgaggggaaangccacctctcctgcagctccagccagaatatccagagctactacatacgcctaggtaccagcagaacgcctggccaggcctcccgaggttcctacacttctatcggccgtcgggtccccaagcgggcccacgtcggccactccccgagacgtacggtttcaggtcggcgtagggtcgggtctacggggaactagggtacctttcgactttccgtactacttactaagtttacggaccgtaaggtaccttaggggaccgtacccgttaaggaacgttacgttttaccggacgttaaggttacggtttaacttttaaccgtaggttaccgtaacggtaaccgttaagggtttaacggttacggggttaaacgttttacccgtaaccccgttttaccggtttacgggtttacccgggttttaacccggggaaaccccggtaaaaaccggggggtaaacccggttaaaaacggggtttaaaaccgtaaaaacggtttaaccggggtaaaaaaacccgggttaacggtttaccgggttaccggggttaaccgtttaacgggaccccgtttaaaaccccgtagtttacccggtttaaccgg

SEQ ID NO: 145373 - DNA, 646 bp, Homo sapiens
  misc_feature: GYAE6OF01DIEMW.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaagcgccaccctctcctgcagctccagccagaatactccagagctactacatagcctggtaccagcagaagcctggccaggcctcccaggttcctcatctatgctcgggtcccagacgggccacgtgggcactcccagaccaggtttccaggtcggacaggttgggtcgtgggaacagtaccttcacgttctactacgtactaatacgtcaacgacgtaggacgacctaggaacgttatttccgacgtagttagtttaagtttactgtacgtagtaccgtaaggttacggttaggtacgtttaccgacgtttcgttcgggttaccggtttaccgggaaccgtaaacggggtaacccgtaaaaggggttaaacgaaaacgttacggtaaaaaccggtaaccgttagggtacggttcgtaaccggtacctaaaccgtacgttccggttaccg

SEQ ID NO: 145374 - DNA, 549 bp, Homo sapiens
  misc_feature: GYAE6OF01EF4J2.21.4.A04.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagngctactacatagcctggtaccagcagaacgcctggccaggcctcccaggttccnatctatgctggcccacgaggccactggcactcccagactaggttcagtggctaggtgggtcgtagggacagtcttcactctacatcattacgacagacgtggacgtcctagaagtactttcgcgtagttagtattactgtcagctagttatgggtaattcctaccttcgtcggttcgttacggaccgtaagggaaccgtaaggtaacgtaaatacggtaaacgaacgttggtacggtctacgacctactagttcttacg

SEQ ID NO: 145375 - DNA, 762 bp, Homo sapiens
  misc_feature: GYAE6OF01BVSPK.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgcccacctctcctgcagcctccagccaagaactactccagacgctaactacatacgccttaggtaccagacaagaacgccgtaggccgaacggcctacccgtaggtttccctacattcttacgtcgtccgtcgggtacccacggacgggcccacggtcggacctacgtacccgaaggtaaccgtacgggtttcacgggttcgggacgtaacggggttcggggttaccgtacggggaaccgtaacgttaccgtttaccgtaaccgttcctacgtaactttaccgtaagtttacggacgtaacggtacgttagggacgtaccgtaggtaaacgttacgtttcggaacgttaggttacgttaatttaacgtgtaccgtaacgtacgtaaggttacgttaagggttaaccttaccgtaccgttacggttaccggttacgggttaaccgggaaccgttaaacgggggaaaccttaaagggggtaaacgtaaacggtaacgggaaaaccggttaacgttgggtaacggtaccgttacgaacccgtacgttaagttcggttaccg

SEQ ID NO: 145376 - DNA, 809 bp, Homo sapiens
  misc_feature: GYAE6OF01CP402.21.4.A04.1.454.CMB.1.raw
  modified_base (270)..(270): a, c, t, g, unknown or other
  misc_feature (270)..(270): n is a, c, g, or t
  modified_base (316)..(316): a, c, t, g, unknown or other
  misc_feature (316)..(316): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatgggagtttgggctgagcttgggttttccttgttgttattttacaaggtgtccagtgtgaggtgcagctggtggagtcgtgggggagacttggtccagccgtgggacgggtccctgacgtactctcctgtcgcagcctntgctattcaccttcagtcgaccacaacagtgggactcggggtcccnccgaggcctaccggaaggggaacggggtcctggggaggttcggggtccggaccgttaattaaccgaaaggaaacgctaaacgagtttaaccaaggttaacaaggtaaacgtaccgggcgtaccggttacttagggtaacggaaaggggtaacgggtttaccaaacccgtaagttaccgtaacgaaaggtacgtaagttacggtaactttaacgaaaaacgtaaccttaccgtaacgttacgttaacttaccgttaaggaacctaaaagttacggaaaacctaaccgggtaacccgttaaacgggaaaaaaccccgggaacgggtaacccggtaacccggggtacccggtttaaggtttaaacgttttaacggtttacgggttaaacggggttaaacggtaaaaccggtaaaaaaagggtacggggttaagggtaaacggtttacggggttagggggttaagggtttaacgggtccggtttagggttaaccggg

SEQ ID NO: 145377 - DNA, 609 bp, Homo sapiens
  misc_feature: GYAE6OF01BH82N.21.4.A04.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatntccagagctactacatagcctggtaccagcagagcctggccaggctccaggttcctcatctatgcgtcgggtcccacgacgggcccacgtcggccaactccccgaagaccgtaggttccaggttgggcgtaggtcgggtcgtggggacacggtacttcacgttctactatctattacgacagacgtggacgtccgtagaacgtatttacgctagttagtactttacgtgtcagtcgtaaggttagtagggtaacgttctaccgttcgtacggttccgttccgggaccgtaaacgggtaaccgtaaagggtaagtaaacgtaacggaaaccggtaacgttcggttacggacttacggtaccaaccgtgttcgttaccgg

SEQ ID NO: 145378 - DNA, 601 bp, Homo sapiens
  misc_feature: GYAE6OF01EP4RO.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaaangccaccctctcctgcagctccagccagaatatccagagctactacatacgcctggtaccagcagaacgcctggccaggcctccccgaggtttccctcatctatcggcgtcgggtcccacgacgggccacgtggccactcccgaagacctaggttcaggtcggcaggttcgggtcgtggggactaggtaccttcgactctacatctagttacgactagacgtggacgccgtagaacgtgtttcgctagttgttattactgtcagtctaagtagtaggtaacgttccaccttcgtcggttccggttacgggaccgtaaacgggtaaccgtaaagggtaaacgtaaagttacggaaacgtaacgttggtacggtacgttacgaccgtaacctgtcgttacgg

SEQ ID NO: 145379 - DNA, 838 bp, Homo sapiens
  misc_feature: GYAE6OF01B1N76.21.4.A04.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttattttacaaggtgtccagtgtgaggtgcagctgggtggagtcggtgggggagacgttggtccaggccgtgggacgggtccctggagactctccgtgtgcagcctctgctattcaccttcagtcgaaccaacaacagtcgggactcgggtcccnccgaggcctaccggaaggggaaggggcctaggggacgggttcggggtccgggacccgttaaagttaaaccggaaaaagggaaaaacgtaccgttaaaaacgtaaacggtttaaaccgaaaggttaaaaccgaaggtaaaaaccggtttaaccggggccggtaccgggtttacgtaaggggttaaagggaaaaaacggggtaacgggtttaacccaaaccctaagttacccgtaacgtaaaaggaaaggtaattaacggtaaatttaaacccgaaaaaggtaaacctacctaaacgttagtaaacttactaagaaacaaaagttaacggaaaccgaaacggtaaccccgtaaaacggggaaaaaccccggaaggggaacccgtaaccggggtaccgtttaacggttaaagtttaacggtttagggtaagggttaaacggaaaacgtaaaaaagggtagggttaagggtaagggttacgggttaggggtttaagggtaggttaccggttgggttaaccgg

SEQ ID NO: 145380 - DNA, 573 bp, Homo sapiens
  misc_feature: GYAE6OF01BEZUJ.21.4.A04.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatactccagagctactacatacgcctaggtaccagcagaacgcctggccaggcctcccgaggtttcccncatctatgcgttcgggtcccacgagggcccacgtggcactcccgagacgaggttcagtggctagggtgggtctgggacagtaccttcactctacatcagttacgcagacgtggacgtcgtagaacgtacttcgacgtagttagttattacttgtacaggtactaagtagtagggtaacgttcaccttcgtgttccggtccggacgtaagggaaccgaaggtaacgaaagtacggaaacgtacgttggacggtacgtacgaccacctgttcgttcg

SEQ ID NO: 145381 - DNA, 630 bp, Homo sapiens
  misc_feature: GYAE6OF01BY21G.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaacgcctggccaggctcccaggttcctcatctatgcgtcgggtcccacgacgggccacgtcggccagtccccgagacgtaggttcaggtcggctaggtcgggtctggggaccaggactttcgaccttctacgatctattacgcgtagtacgtggacgtctagaagtactttcggactaggttagttatttacgtgttacgtaagctaaggttagtagggtaacgtttccaaccgtttcgtacggttccggttaccgggaccgtaaacggggtaacctaaaggggttaacgtaaaagttacgggtaaaaccggtaacgttagggtacgggtaccgttacggtaccgtaaacccgtagttcgttaccgg

SEQ ID NO: 145382 - DNA, 672 bp, Homo sapiens
  misc_feature: GYAE6OF01C0KCW.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggcacctgtctttgctcgaggggaancgccaccctctcctgcagcctccagccaagaatactccagagctaactacatacgcctggtaaccagacaagaagcctggccaggcctcccgaggttcctcattctatcgctcggggtcccagacgggccacgtcggacctactccccgagaacctggttccaggtcggcgtaggtcgggtctaggggactagtactttcacttctacattactaagttacgactagtaccgtagggacgtaccgttaaggtaacgttacgttttcggaccgttaagttacggtttaacttttacgtggttaccgaacgtacgttaaggtttaggtacgggttaacgtttcctaacccgtttcgttacggttaccggttaccgggaacccgtaaaggggtaacccgtaaagggtaaacgtaaaacgttaacggtaaaaccggtaacgttggtacggtactacgacctaaccgtcgttcgttacg

SEQ ID NO: 145383 - DNA, 565 bp, Homo sapiens
  misc_feature: GYAE6OF01D0K56.21.4.A04.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaangccaccctctcctgcagctccagccaagaatacnccagagctactacatacgcctaggtaccagcagaacgcctggccaggcctcccgaggtttcccncatctatcgcgtcgggtcccagacgggccacgtggccactcccagacaggttcaggtggcaggtgggtctggacngtacttcacttctacatcattagcagtacgtggacgtcgtagaagtcgtttcgacgtagttattattactgtacagacgtagtagtagtacgttcaccttcgtcgtcgttccggaccgaacgggtaaccgtaagggtaacgaaagtacggtaaacggtaacgtggtacggtactacgacctactgttcgtacg

SEQ ID NO: 145384 - DNA, 665 bp, Homo sapiens
  misc_feature: GYAE6OF01BH6DQ.21.4.A04.1.454.CMB.1.raw
  modified_base (197)..(197): a, c, t, g, unknown or other
  misc_feature (197)..(197): n is a, c, g, or t
  modified_base (308)..(308): a, c, t, g, unknown or other
  misc_feature (308)..(308): n is a, c, g, or t
tcagtcgtcgctcgcacgaccggtgctcgatttagagtagtgatcagggggagagctggctcagttaggacccagagggaaccatggaaaccccagcgcagcttctcttcctcctgctactctggctcccaggtgtcaccggagaagttgtcttgacgcagtctccaggcaccctgtctctgtctccaggggaaagngttactctctcctgcaaggccagtcagagtgttggcatcggacgttgcctggtaaccaaacaaaacctggccaggctcccagtcctcctcatctagtggggacactcctanaggatcggaccggcactcccgagacgaggttcaggtgccgtagtgggtctcgggacagtacttcactctaccaccataccaaacacacgtcggccgaccgtagaagttagttttgacgtacgttagttaacttacgtggtacaagtactaggttaagttcggggttacggtacccttaaccgtaaccgtttacccggtttacgggacccgggtaacggggtaacccgtaaggggtgggaacgtacgttaccggaacggtaaccggtaaacgtcgggtacgggtacctcggaccctaaccgtacgttccgttacggtttacccttaccgtaaccctttcccccgtttaccccgtaccc

SEQ ID NO: 145385 - DNA, 705 bp, Homo sapiens
  misc_feature: GYAE6OF01CQVEL.21.4.A04.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
tcagtcgtcgctcgcacgaccggtgctcgatttagagtagtgatcaggggagagctgctcagttaggcccagagggaaccatggaaaccccagcgcagcttctcttcctcctgctactctggctcccaggctcagaaaccaccggagaaattgtgttgacgcagtctccaggccaccctgtctttgtctccgaaggggaaancgccaccctctcctgcagctccagccaagaatanccagagctactacatagcctggtaccagcaagaagcctggccaggcctcccgaggttcctcattctagtcgcgtcgggtacccacgacgggcccaacgtcggactacgtcccaaggtacgtaacggttcaagggtggaccgtagggtcgggtcgtaggggaactaggtacctttcacttctcaatctaagttagccgtaagaccgtaggacgtaccgtaggtaaagtactttcggacttaaggttcgttaactttacgtggtaaccgacggtacgtaaggttaagttacggggtaaactttcccgtaacccgtttcggttaccgggtttacccgggttaccgggaacccggaaaacgggggttaaccctaaaaaggggttaaacgtaaaacgttaacgggaaaaaccggttacggttggtaacggggtaccttaacgggaaccctaaaccgttagttccgtttaaccgg

SEQ ID NO: 145386 - DNA, 620 bp, Homo sapiens
  misc_feature: GYAE6OF01DT2GZ.21.4.A04.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggaggagctgctcagttaggacccagagggaaccatggaaacccagcgcagcttctcttcctcctgctactctggctccaggctcagaaaccacggagaaattgtgttgacgcagtctcaggcaccctgtctttgtctccgaggggaanatccaccctctcctgcagcctccagccaagaatactccagagctactacatacgcctaggtaaccagcagaacgcctggccaggcctcccaggttccncatctatcgcgtcgggtcccagacgggcccacgtggccactccccgaagacctaggttccaggtcggcgtagggttcggggtactcggggaacagtaccttcgacttcgtactatctagttacgactaaggtacgtgggacgtccgtaggaagttactttcgacgtagttagttatttacgtgtcacgtcgtaagtagtacgggtaattcctacgttcgtcggtcggttcggaccgtaacgggtaaccgtaaagggttaacgtaaagtacggaaaacgtaacggttaggtacggtaccgtacggacctaacccgtgttcgttacg

SEQ ID NO: 145387 - DNA, 867 bp, Homo sapiens
  misc_feature: GYAE6OF01DU5EW.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagcctccagccagaatactccagagctactacatacgcctaggtaaccagcaaggaacgccgtgggacccaacgggccttacccccgagggttttcccctacgtaacttccgttaagtcggtccgttcggggtacccccaacggacggggtccccaacgttcgggacctaacgttcccccgaaggtaaccgtagggtttccaagggttcgggaccgtaaggggtttcggggttccgttacggggggaaccctacgggttaacccttttccgaaaccgtttccgtaccgtaacttaccgtaaagtttaccggaccgtaaggtaacccggttagggaaccgtacccgttaagggtaaacgttacgtttttaccggaccgttaagggtttacgtttaacgttttaaccgttacggttaccgaacgggtaccgttaagggtttaacggtttacggggttaaaccgttttcccgtaaccccgtttcgggtttaccgggtttaccccgggtttaacccggggaacccggtaaaacggggggtaaaccccgtaaaaagggggttaaacgtaaaaacggttaacgggtaaaaaaccggttaacgttcgggttaacgggtaccgttaacggacccgtaaacccgttagttccgtttaaccgg

SEQ ID NO: 145388 - DNA, 567 bp, Homo sapiens
  misc_feature: GYAE6OF01B6R63.21.4.A04.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (373)..(373): a, c, t, g, unknown or other
  misc_feature (373)..(373): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagctccagccagaatatccagagctaactacatagcctggtaccagcagaagcctggccaggcctcccgaggttcctnatctatgctcgggtccagngggccagtggcatcccagacaggttcaggtggcaggtgggtctgggacagacttcactntcatcattagctaagctaggacgtacgtagaagtctttcgactagtagttattctgacagctaagtagtagggtacttacaccgttcgtaggtccggttacggaccgtaaacgggtaaccggtaaaggttaaaggtaaacgtacggaaaaccgtacgttaggtacggcgttacgacctacgtactcgttaccgg

SEQ ID NO: 145389 - DNA, 582 bp, Homo sapiens
  misc_feature: GYAE6OF01BW5V4.21.4.A04.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccaagaatactccagagctactacatagcctggtaccagcagagcctggccaggcctccccgaggttccctnatcctatcgcgtcgggtcccacgcgggcccagtggcactcccgagacgtaggttcaggtggctaggtgggtctgggactagtcttcgactctcatcattagctagtacgtggacgtactagaagtactttcgcgtagttgtagtttactgtcgagtacgtaggtagtaggtaacgttcctaccgttgttcggttcggtccggtaccgtaaacgggaacgtaaacggtaagaaacgtagtaaaccggtacgttaggtacggtacgtacgaccactagttcgttacg

SEQ ID NO: 145390 - DNA, 599 bp, Homo sapiens
  misc_feature: GYAE6OF01EPD9C.21.4.A04.1.454.CMB.1.raw
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctcgaggggaagacgccacctctcctgcagcctccagccagaatactccagacgctactacatacgcctaggtaccagcagaacgcctggccaggcctccgaggttccncatctagtcgcgtcgggtcccacgacgggccacgtcggacactcccagactggttcaggtcgcgtaggtcgggtcgtagggactagacttcacttctactactctattacgactagacgtaggacgtctagaacgtattcgactagttgttacttacgtcgtacagtctaggtagttacggtaacgttcctacgttcgttacggttaccgttacggacccggtaagggtaacccgtaagggtaacgtaaagtacggaaacgtaacgtacggtacggtactacggacctaacgttagtcgttacg

SEQ ID NO: 145391 - DNA, 628 bp, Homo sapiens
  misc_feature: GYAE6OF01BTQIC.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaanagccaccctctcctgcagctccagccaagaatatccagagctactacatacgcctggtaaccagccagaacgcctggccaggcctcccgaggttccctcactctatcgcgtcgggtcccacgacgggccacgtcggcactcccagtactaggttcaggtcggctaggtcgggtctagggactagtaccttcacgttctcgacttctagttacgacagtacgtggaacgtccgtaaggtaacgtacgtttcgacgtaggttacgttaactttacgttgtacgtagtacgtaaggttagttacgggtaacgtttcctaaccgttcgttacggttccggttaccggaccgtaaacgggaaccgtaaagggtaacgtaaagtacggtaaacgtacgttggtacggtcgtacgacctaccgtagttcgttaccg

SEQ ID NO: 145392 - DNA, 581 bp, Homo sapiens
  misc_feature: GYAE6OF01BL32T.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatactccagagctactacatacgcctggtaccagcagaagcctggccaggcctacccgaggttccctcattctaagtcggtccgtacgggtcccacgacgggccacgtggctactcccgagaccgtaggttcaggtcggacgtaggtcgggtctcgggacagtacttcactctacatcattacgcagacgtggacgctagaacgtattcgcgtagttgtattagtcgtacagtacgtagtagtaggtacgttcaccgttcgtcgttccggttacggaccgtaaacgggtaccgtaaggtaacgtaaagtacggtaaacgacgttaggacggtactcgacactcgtcgttacg

SEQ ID NO: 145393 - DNA, 757 bp, Homo sapiens
  misc_feature: GYAE6OF01EHKPG.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgctcgaggggaancgccaccctctcctgcagctccagccaagaatactccagagctactacatacgcctggtaccagcagaacgcctggccaggcctaccccgtaggtttccctacgacttccgttagtcggccgttcggggtaccccaacggacgggcccacgtgggacctacgtccccgaagtaccgtacggttcgaacgggttcgggaccgtagggttcggggtacgtaggggacctacggtacctttccaaccgttctacgtactacgtaacgtttacggactacggtaccgttagggacgtccgttaaggtaaacgttacgtttccggacttaggttacgttaactttacgttacgtacgtacggtacgttaaggttacgtacgggttaaccgtttaccgtaaccgttcggttacgggttacccgggttaccgggaaccggtaaacggggtaaaccgttaaacggggttaaacgtaaaacggttaacgggtaaaaccggttaaccggttacgggttaacgggtaccgttaaccggaacccgttaacccgttaagttcccgtttaccgg

SEQ ID NO: 145394 - DNA, 754 bp, Homo sapiens
  misc_feature: GYAE6OF01A0ZT4.21.4.A04.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctntcctgcagctccagccagaatatccagagctactacatacgcctggtaccagcagaacgcctggccaggcctcccgaggttcccncatctagtcgccgtcgggtcccacgacgggcccacgtcggccacgtcccgagtaccgtaggtttccaggttcggcgtagggtcggggtctagggggaacctaggtaccctttccgaaccgtttcgtacctaagttacctaagtttaacgaccgtacggtaacgtacgggtacgtaccgttaaggtaaacggttacgttttaccggacgttaacggtttacgtttaacgtttacgttaggttaccgtaacggtaccgtaaggttaacggttacggggttaaaccgtttccgtaacccgtttcggttaccgggtttaccgggttacccgggtaacccgtaaaacgggggtaacccgtaaaacggggttaaacgtaaaacgttaacgggtaaaaacccggtaaaccggttagggtacgggtaccgttaccgggaacctaacccgttaaggttccgttaccgg

SEQ ID NO: 145395 - DNA, 620 bp, Homo sapiens
  misc_feature: GYAE6OF01AQ82T.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaaggggaancgcccaccctctcctgcagcctccagccaagaatactccgagacgctaactacatacgcctaggtaccagcaagaacgccgtggccacggcctacccgaggttccctacgacttctagtcgccgttcgggtacccacgacgggccagtcggcactcccgagaccgtaggttcaggtcggacgtaggtcgggtctagggactaggtacctttcaccttctactatcgtattacgacgagtacgtggacgtccgtagaacgttcgttacgcgtagttagttacttacgtgtacgagtcgtaagtagtacggttacttacctacgttcgtacgttaccggtacggaccgtaaacgggtaaccgtaaaggtaacgaaagtacggaaacgtacgttggtacggtctacgacctactagttcgtcg

SEQ ID NO: 145396 - DNA, 551 bp, Homo sapiens
  misc_feature: GYAE6OF01ECJA1.21.4.A04.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaaangccacctctcctgcagcctccagccagaatatccagagctactacatacgcctggtaccagcagaacgcctggccaggcctcccgaggtttcccncatctatcgcgttcgggtaccccacgacgggcccacgtcggctacgtccccagaccgtaggttcaggtcggctaggtgggtctgggacagtacttcactctacatcattacgcagacgtggacgcgtagaagtnttcgctagttgtattcgtgtnagctagtagtaggtacgttcacgttctcgttcgttcggaccgtaagggaaccgaaggtaacgaaagtaggaaacgacgtgtacgctacgaccactgtcgtacg

SEQ ID NO: 145397 - DNA, 812 bp, Homo sapiens
  misc_feature: GYAE6OF01A7YA9.21.4.A04.1.454.CMB.1.raw
tcagtcgtcgctcgcacgaccggtgctcgatttagagtagtgatcgagggagctctgagagcggacgccccacgccccagaacttcccaggttgttttcatttggtgatcagcactgaacacagaggactcaccatggagtttgggctgagcttgggttttccttgttgttattttacaaggtgtccagtgtgaggtgcagctggtggagtcggtgggggagtacgttggtccagccgtgggacgggtccctgacgactctccgtgtgcacgcctctgctattccaccttcagtcgaccacaacagtggacgtcgggtcccgccgaggcctaccggaaggggaacggggcgtgggagggttcggggtccggaccggttaagttaaccggaaaagggaaacgtaccgttaaaacgtacggtttaacgaaggttaaacgaaacggtaaacgtaaccggggaccgtaccggttaccgttagggtaagggtaaaaacggggtacggtttacccaaacccgttagttaaccgttaacgaaaagggtaagaactttacggtaaacgtttaaccgaaaaaaggttacccttaccgtaaacgttgttaaacttaccgtacgaaacctaaagtacggaaacccacggtaacccgtaaaccgggaaaaaccccggtggaacccggtaccggggtacccgttaaggtttaaacgtttaaggtttacggggtaacgggtaaagtaaaaccggtaaaaaagggtcgggttaagggtaacgtttggggtagggggttacggttaacgtccggttagggtaaacccg

SEQ ID NO: 145398 - DNA, 496 bp, Homo sapiens
  misc_feature: GYAE6OF01DA4T5.21.4.A04.1.454.CMB.1.raw
  modified_base (199)..(199): a, c, t, g, unknown or other
  misc_feature (199)..(199): n is a, c, g, or t
  modified_base (350)..(350): a, c, t, g, unknown or other
  misc_feature (350)..(350): n is a, c, g, or t
  modified_base (465)..(465): a, c, t, g, unknown or other
  misc_feature (465)..(465): n is a, c, g, or t
  modified_base (490)..(490): a, c, t, g, unknown or other
  misc_feature (490)..(490): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaccaccggagaaattgtgttgacgcagtctccaggcaccctgtctttgtctccgaggggaaangccaccctctcctgcagctccagccagaatatccagagctactacatagcctggtaccagcagaagcctggccaggctcccaggttcctcatctatgctcgggtcccagcgggccacgtggcactcccagacaggttcagtgcagtggtcngggacagtacttcactctacatcattacgcagactggacgtcctagagtatttcgctagtgtattactgtcagctagtagtgtattcacttctgtcgtcgacgaggacaaggtanaatagaaacgtagtgcgctagcacntcgtcg

SEQ ID NO: 145399 - DNA, 684 bp, Homo sapiens
  misc_feature: GYAE6OF01DMQ91.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaacncgccaccctctcctgccagcctccagcccaagaactactccgaagacgtacctaactacagtacgccctaggtaacccagcaagaacgccgtggccaggtcctcccgtaggttccacgtacttctagtcggccgttcgggtacccacgtacgggccctacgtcggaccacgtacccgagaccgtacggttcgaggtcggacgtagggtcgggtcgtagggaactacggtaccttcgacttccgtactacttaccgtaagttacggcgtaagtacgtacgggtacgtccgtaaggtaacgttacgtttacgagttacgttagttaactttcgtagtacgagtcgtaagttacgttacggttaacgttccgtacgttcgttacggtacccggttaccggaaccgtaaacgggtaacgtaaaggtacgtaaacgtaacggtaaacgtacgtagggtacgtacgtacgacctaccgtgtcgttacg

SEQ ID NO: 145400 - DNA, 849 bp, Homo sapiens
  misc_feature: GYAE6OF01EP0TH.21.4.A04.1.454.CMB.1.raw
tcagtcgtcgctcgcacgaccggtgctcgatttagagtagtgatcaggggagagctgctcagttaggacccagagggaaccatggaaaccccagcgcagtcttctcttcctcctgctactctggcctcccaggctcaacgaaacccgaccggaagtaaattggtgttgacgcagtcctccgaggcctaccctgttctttgtcctccggaaggggaaagcgccctaccctctcctgcacgtcctaccacgaccaagtaactactacccagacgtaccttaactaactaagtaccgtccgttacggtaacccaggaccaaaggaaccgtcccgtcgggacccgacggtccctaccccgtacggtttccctacacttctagtcgtccgtccgggtacccacggacgggccctacgtcggacctaccgtacccgacggtaaccgttaggttccgaagggtcggacgtagggttcgggtaccggtaggggtaacctacggttaccctttacctaccgtttccgtacctaacttacttaagtttacgaccgtaacggtaccggttacgggaaccgtaccgttaaggtaacgttacgtttaccggacgttaggtttacgtttaacgtttacgttacggtacgtacggtacgttaaggttaacgttagggttaaaccgtttaccgtacccgttaccggtttaccggtttacccgggttacccgggaacccggtaaacccggggtaaaccgttaaacggggtaaacggttaaaacggtaaacgggtaaaaccggttaacgttacgggtaacggttaccggttaccggaacccttaacccgttacgttccgtttaccgg

SEQ ID NO: 145401 - DNA, 594 bp, Homo sapiens
  misc_feature: GYAE6OF01D0D4Y.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaangccaccctctcctgcagctccagccagaatatccagagctaactacatagcctaggtaaccagcaggaacgcctgggccaggcctcccgaggttccacatctatgcgttcgggcccagacgggcccacgtggcactcccagaccaggttcagtggctaggtgggtctgggacagtaccttcacttctacatcattagctagacgtggacgcgtagaagtacgtttcgacgtagttgttacttacgtgtacagtctaaggtacgttagggtaactttccgaccgttcgttcggttccgttaccgggaccgtaaacggggtaacctaaagggtaacgtaaaagtacggaaaaccggtacgttgggtacggtcgtacggaccctacgtagttcgttacg

SEQ ID NO: 145402 - DNA, 560 bp, Homo sapiens
  misc_feature: GYAE6OF01E0NW6.21.4.A04.1.454.CMB.1.raw
  modified_base (202)..(202): a, c, t, g, unknown or other
  misc_feature (202)..(202): n is a, c, g, or t
  modified_base (403)..(403): a, c, t, g, unknown or other
  misc_feature (403)..(403): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngccaccctctcctgcagctccagccagaatactccagagctactacatacgcctggtaccagcagaagcctggccaggcctcccaggttcctcatctatgcgtcgggtcccacgacgggccacgtggcactcccagacaggttcagttcgctaggtgggtctgggacagacttcactctcatcattagcagtacgtggacncgtagaagtagtttcgacgtagttgttattactgtcagtctaagtagtaggtaacgttccaccttcgtaggttccggtaccggaccgtaaagggacctaagggtaacgtaaagtaggaaaccgtacgtggtacgtacgtacgaccacctgtcgttcg

SEQ ID NO: 145403 - DNA, 559 bp, Homo sapiens
  misc_feature: GYAE6OF01EAU4Z.21.4.A04.1.454.CMB.1.raw
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcggcgtttcgtntaggtcgttacaagtagtcagtgtgagtgcagctggtggagtntggggagacttggccagcctggaggtcctggacnctctctgngacacgctctnctactctactcacgtacacacacatgacgtcggtcgcgcgcgacgacggaggcgtggtaggtcggtcgtacgtacgtacgaagaagactaacgtacgtacaagtaacgagaacgtacgcgtcgtacgtagtagtaaggtaacgtacgtacactactacgaagagatagtactactaacgtaactactactagtatactatactaagtaacgaacgacgtacgtaacgaacgaacgacgacgtacgtagtagttagttagtagtaagaagaacgtaagtagtagtagtagtagtacgtgtgtacg

SEQ ID NO: 145404 - DNA, 1023 bp, Homo sapiens
  misc_feature: GYAE6OF01B43V9.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggccaccctgttctttgtctaccgaaggggaaacgcgcccaccctctcctgcacgctccagccaagtaatactaccgagtacgctaactacatacgccttaggtaacccaggacaaggaacgtccgtacgggacccgtacgggtccccttaccccgacgggttttaccccacgtaacgttcccgttaagtccggtaccggttacccggggttaccccaaaccgggaccgggggtacccctaaccggttacgggaccctaaacccgttacccccggaaggttaaaccccgggtaccggggttttaacaaccgggggttacgggtaacccggttaacgggggtttccgggggttacccggtaacggggggtaaaccctaccggttttaacccgtttaccggtaaacccctttcccgtttaacggtaaccgtttacccgttaaaggttttaaaccggggttaacgggttaacccggttaggggttaaccccgggttaaccgtttaaaggggttaaaaccggtttacgtttttaccccgggaaggtttaaacggggttttaacttttaacggttttaaacccggttcggttaacgtaacgggttaccggtttaaaggtttaacgggtttacgggttaaacccgttttaccctaaccggtttccggttttacgggttacccgggtttaacccggggtaacccgggtaaaaaccgggggttaacccggttaaaaaggggttaaaccgggtaaaacgtttaaacgggggaaaaacccgttacgggtttaacccgggttacgggtaacccttaacgggacccttaaaccggtttcgttacccggtttcgtttaaccccg

SEQ ID NO: 145405 - DNA, 782 bp, Homo sapiens
  misc_feature: GYAE6OF01C2PXT.21.4.A04.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagagtagtgatcaggggagagctgctacagttaggaccagagggaaccataggaaacccagcgcagcttctcttcctcctgctactctggctccaggctcaacgaaaccaccggaagtaaattggtgttgacgcagtctcaggcacctgtcttgctacgaagggaaacacgccctacctctcctgcagctccagaccaagaactacnccgaagacgacctaactaacacgttacgccgttacggtaacccaggacaaggaacgtccgtacgggaccacgggtcctaccccgtaaggttccctacgactccttaacgcggtacccgttaccggggtacccaaccggtaaccggggccctaacggttcggaaccctaaccgttaccccgaaggtaaccgtaacgggttccgaagggtcggtacccggtaggggttcgggttaccgggtaggggaacctacgttaccgttacgtaccgtctacgtaacttacgtaacggttaacgacgtaacggtacgtacggacgaccgtaaggtaacgttacgtttaccgacgtacggtttattaacgtttacgtacgtacgaacggtacgtaaggttaacgttaggtaaccggtttcctacgttacgttcggttacccggttacgggaaccggtaaaacgggaaaccgttaaaagggtaaacgtaaaggtaacggtaaaacggtagttacgggtacgtaccgtacggaaccctacgtcgttcgtttacg

SEQ ID NO: 145406 - DNA, 523 bp, Homo sapiens
  misc_feature: GYAE6OF01AMZ8Z.21.4.A04.1.454.CMB.1.raw
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (500)..(500): a, c, t, g, unknown or other
  misc_feature (500)..(500): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccgccaggctccgagggaagggctgggagtgggtcggccgtattacgaaggaagctaacagttacagtacagaatacggcgcgtctgtaggaaaggtaggttcaccatcctacaagagatgaattacaaagactcactgtatctgacaaatgaacagacctagaaaccgnggacacggccgtntattatgtgtagacaaagngtgatggtaggtgagtgtgtacg

SEQ ID NO: 145407 - DNA, 759 bp, Homo sapiens
  misc_feature: GYAE6OF01AKF1O.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatatccagagctactacatagcctggtaccagcagaagcctggccaggctcccgaggttcctcatctatcgcgtgggtccccacgtacgggcccacgtcgggccacgtccccgaaggtacctagggtttccaagggttcgggcctaagggtttcgggggttaccttgggggaaacctacgggtaccttttccgaaccgtttccttaccgaactttaccgtaagttttaacgggaccgtaaacgggtaaccgttacggggtaacggtaccccgttaagggtaaaacggttacgtttttaccgggacgttaacggtttacggtttaacgtttaacccgttggttacccgtaaggtacccgtaaggttacgttacgggttaaacgtttcccgaacccgtttcgttacggtttaccggttacccggggaacccgtaaacgggggtaaccctaaaggggttaacgtaaaagttacgggtaaaaccggtaacgttcggtacgggtactacggacccgtaaccgtagttccgttacgg

SEQ ID NO: 145408 - DNA, 545 bp, Homo sapiens
  misc_feature: GYAE6OF01A1UBI.21.4.A04.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctntcctgcagctccagccagaatatccagagctactacatagcctggtaccagcagaagcctggccaggcctcccaggttcccncatctatgctcgggtcccagacgggccacgtggccatcccagacaggttcagtcggcaggtcgggtctggggacaggtacttcacttctacatcattagcagactggacgccgtagaagtatttcgctagtagtattacgtgtcagctagtagtagtatctactcgtcgtcgttcggaccgtaaagggtaccgaaagggtacgaaagtacggaaacgtaacgttggtacggtctaggaccaaccgtagtgttacg

SEQ ID NO: 145409 - DNA, 567 bp, Homo sapiens
  misc_feature: GYAE6OF01A98D2.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatatccagagctactacatacgcctggtaccagcagaacgcctggccaggcctcccaggttccctacatctatcgcgtcgggtcccacgacgggccacgtcggcacgtcccagactaggttcaggtggctaggtgggtcgtgggacagtacttcacttctacatcattacgcagacgtaggacgtcgtagaagtattcgctagttgtacttcgtgtcagctagtacgtaggtaacgttcctacgttcgtcgttcggttacggaccgtaacgggaaccgtaaggtaacgtaaagtacggaaacgtacgtaggtacggtctacgacacgtagttcgtcg

SEQ ID NO: 145410 - DNA, 545 bp, Homo sapiens
  misc_feature: GYAE6OF01BSSVM.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgcctttgctccaggggaaancgccaccctctcctgcagctccagccagaatatccagagctactacatagcctggtaccagcagaagcctggccaggcctcccgaggttcctcatctatgctgggtcccagacgggccacgtggcacgtcccaggaccaggttcagtggcaggtgggtctggggacagacttcactctcatcattagcagactggagccgtagaagtactttcgactagtgtattacgtgtacagctagttagtagggtaacgttcaccttcgtcgttccgttcggaccgaaacgggtaccaaagggtaagaaataggaaaacgtacgtggtacggactgacctactattcgtacg

SEQ ID NO: 145411 - DNA, 737 bp, Homo sapiens
  misc_feature: GYAE6OF01ECTS8.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgagggaancgccaccctctcctgcagctccagccagaatatccagacgctactacatacgccgtaggaccagcaagaacgcgtcggccaggcctacccgaggttccctgacttctagtcgcgtccgggtacccacggacggccctagtcgggacctacgtacccgaaggtaaacgttcgaggttcggacgtagggtcgggtcgtacggggactaggtaccttcacgttctacagttacgtaagttaacgctaacggtacgttacgggacgtccgttaagtaacggtttacgtttaccggacgttaaggtttacggtttaactttaccggtagttacgtaacggtacgttaaggttacggttaacgggttaacgtttacccgttaccggtttacgttacgggtttacccggttaaccggggaaaccggtaaaacgggggtaacccgtaaaaggggttaaacgtaaacggttaacggaaaaccggttacggttacgggtacgtaccgtacggtaccctaaccgttacgtttccgttaccgtttacccg

SEQ ID NO: 145412 - DNA, 599 bp, Homo sapiens
  misc_feature: GYAE6OF01A8SY4.21.4.A04.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgtctccaggggaaangccaccctctcctgcagctccagccagaatatccaganctactacatacgcctggtaccagcagaacgcctggccaggcctcccaggttccctcattctatcgccgttcgggtccccagacgggccacgtggccacgtcccgaagactaggttcaggtggcgaggtgggtctgggacagtacttcactctacatcagttacgcagtactggacgtcgtagtaacgtatttcgactagtcgttattacgtgtacgagtctaagttacgtaggtaacgttcctaccgttacgttcggttaccggttaccggaaccgtaacggggtaaaccgtaaagggttaaacgtaaaggttacggtaaaaacgtacgttggtacggtcctacggacctactgttcgtacg

SEQ ID NO: 145413 - DNA, 780 bp, Homo sapiens
  misc_feature: GYAE6OF01BFPUW.21.4.A04.1.454.CMB.1.raw
  modified_base (770)..(770): a, c, t, g, unknown or other
  misc_feature (770)..(770): n is a, c, g, or t
tcagtcgtcgctcgcacgaccggtgctcgatttagagtagtgatcagggggtaggagctgctcagttaggacccagagggaaccatggaaaccccagcgcagcttctcttcctcctgcttactctggctcccaggctcagaaaccaccggagaaattgtgttgacgcagtctccgaggcaccctgtctttcgtcgtccagggggaaagacgccaccctctcctgcagctccgagtccaagtaatactccagagtctaactacgatacggcccgttacgggtaacccaggccaacggaaacggtcccgtgggacccgaagggtcctccccgtaggttccctacgtaagttccttaacgtcggtccgttacgggggttaccccaacggaaccgggggacccctaaccgttacggggcccaaccgttcccccggaaggaaccgtaacgggtttaccaaagggttcggggacctaagggttcgggggttaccgtacgggggaacctaacgggtaccctttacgacccttcgtactaacgttaccgtaagtttacggacctaacggtacgttagggacgtaccgtaggtaaacggtacgtttaccggacgtaggttacgttaacgtttacgtcggttacgaaggtactaaggtacgttacgggtaacgtttcctaaccgttcgttcggtccggttacgggaccgtaaacgggaaccaagggttaacctaaggtaacggaaaccgtacgtacggtacggtccgtacgcctaacgtntccggttacg

SEQ ID NO: 145414 - DNA, 576 bp, Homo sapiens
  misc_feature: GYAE6OF01DF133.21.4.A04.1.454.CMB.1.raw
  modified_base (290)..(290): a, c, t, g, unknown or other
  misc_feature (290)..(290): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaccaccggagaaattgtgttgacgcagtctccaggcaccctgtctttgtctccgaggggaaagcgccaccctctcctgcagctccagccagaatatccagagctacacatagcctggtaccagcagacgcctggccaggcctccaggttccncatctatgctcgggtcccagacgggccacgtggcctacgtcccagactaggttcaggtcggctaggttgggtctaggggacacggtacttcacttctactactactattacgactaggtactggacgccgtagaagtctttcgactagtgttattactcgtacagctagtagtaggtacttccaccgttcgtacgttcggttaccggaccgtaaacgggaccgtaaagggtaacgaaagtacggtaaacggacgtggtacggtctacgacctaactgttcgttacg

SEQ ID NO: 145415 - DNA, 668 bp, Homo sapiens
  misc_feature: GYAE6OF01ARLKW.21.4.A04.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctcctgtgcagcctctgcattcaccttcagtcgaccacaacagtggactcgggtccgccaggctccgagggaagggctggagtgggtcggcgtatacgaaggaagctaacgagttacagtacagaactacgggcgcgtctggagaaagggaggttcaacctagtctacgaaaggtagaattcggaactttacgaaaaagtaaccgtctaacgttagttaacgttactacggtaactaaaattacgggaaacctaacggtaccccgttaaaggaaaaacccggtcgggaaaccgtacccggtacccggttagttaaacttttaaggttacgggttacggtaaacggaaacggtaaaaaagggtcgggttagggaaaacgttggggtttaacgggtaagggttaaggccgtttagggtaacccg

SEQ ID NO: 145416 - DNA, 636 bp, Homo sapiens
  misc_feature: GYAE6OF01BP5P6.21.4.A04.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (298)..(298): a, c, t, g, unknown or other
  misc_feature (298)..(298): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagcctccagccagaatanccaganctactacatacgcctggtaccagcagaacgccgtggccaggcctcccgaggttcccnactctagtcgcgtcgggtcccagacggccagtcggccactcccgaagccgtaggttcaggtggcaggtcgggtctagggactaggtacctttcgaccttctacgtatctacttacgcgtaagtacgtaggacgtccgtaagtaacgttacgtttcggacgtagttagttaactttacgtcgtacgtagtacgtaagttaacggtacgggttaacgttccgtacccttcgttcggttaccggtaccgggaccggtaaacggggtaaccgtaaagggtaacgtaaagtacggtaaaacggtacgttggtacggtacgtacgacctaaccgtgttcgtacg

SEQ ID NO: 145417 - DNA, 720 bp, Homo sapiens
  misc_feature: GYAE6OF01BTW2I.21.4.A04.1.454.CMB.1.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaangccacctctcctgcagctccagccagaatatccagagctactacatagcctggtaccagcaagacgcctggccaggcctcccgaggttccctnatcctatcggcgtcgggtcccacgagggcccacgtcggacactcccgaagacgtaggtttcaggtcggctaggtcgggtctagggactaggtaccttcgaacttccgtactaattctaagttacgacgtaacgtacgtagggacgtaccgtaaggtaaacggttacgtttccggaacgttaggtttacgttaacgttttacgttacggttaccgtaacggtacgtaaaggtttacggtaacgggttaaacgtttccgttaacccgtttcggttacgggtttaccggttcccggggaaacccgttaaacgggggtaaaccgtaaaacggggttaacggaaaaacgttaacgggtaaaacccggttaaacggttacggggttaacggtaccgttacggaacccgttaaccttaacgtttaccggtttaccg

SEQ ID NO: 145418 - DNA, 759 bp, Homo sapiens
  misc_feature: GYAE6OF01AVHZ7.21.4.A04.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaanagccaccctntcctgcagctccagccagaatatccagacgctactacatagcctggtaccagcagaagcctggccaggcctcccgaggttccctcatcctatcgcgtgggtcccacgacgggccacgtggccactcccgaagacgtaggttcaggtcggacgtaggtcgggtctaggggactacggtacctttcgaccttcgtacctaacttcgtaacgtttacggaccgtaacgggtaaccgttaggggtaaccggtacccgtttaagggtaaaacggtttacgtttttacccgggaccgttaacggggttttacggtttaaacttttaacccggttacggttaaccgtaacggtacccgttaagggtttaacggttaacggggttaaaccgttttacccgtacccgtttacggttacgggttcccggtttacccggggaaacccgtaaacgggggtaaacccgtaaaacgggttaaacggtaaaaggttacggtaaaaaccggtaacgttagggttacggtaccgttacggaacctaacccgtaacttccggttaacg

SEQ ID NO: 145419 - DNA, 578 bp, Homo sapiens
  misc_feature: GYAE6OF01BNB8E.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctntcctgcagctccagccagaatatccagagctactacatacgcctggtaccagcagaagccccctggccaggcctacccgaggttccctcactctatcgtccgtcgggtcccacgacgggcccacgtggctactcccagactaggttcaggtggcaggtggtcngggacacgacttcactctcatcattagcaagcgtggacgtctagaagtntttcgcagttgtaacgttactgtacagtctagtagtacggtaacgtttcctaaccgttcgtacggttccgttacgggacctaaacggggaccctaaaggggtacgtaaaagtacggaaaaccgtacgtggtacggacgttcgacctactagtcgtacg

SEQ ID NO: 145420 - DNA, 599 bp, Homo sapiens
  misc_feature: GYAE6OF01ATY2O.21.4.A04.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagcctccagccagaatatccaganctactacatagcctggtaccagcagaacgcctggccaggcctcccgaggttccctcatcctatcgcgtcgggtcccagcgggccacgtggccactcccagacctaggttcaggtcggcgaggtcgggtctgggacagtacttcactctcatctattacgcaggactggacgtcctagtaagtacgtttcgacgtagtagttacttacgtgtaccgagtcgtaaggttagtacggtaacgttcctaccgttcgttacggttaccggttcccgggacgaaacggggtaacctaaagggtaacgtaaacgtacggaaacggtacgtagggtacgtacgtacggacctaacctgttcgttacg

SEQ ID NO: 145421 - DNA, 569 bp, Homo sapiens
  misc_feature: GYAE6OF01DABSV.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgtctccaggggaaanatccacctctcctgcagcctccagccagaatatccagagctactacatagcctggtaccagacagaagcctggccaggctcccaggttcctacatctatgctcgggtacccacgacggggccacgtggccatcccagacaggttcagtggcaggtgggtctgggacagtacttcactctacatctatttagctagacgtgggacgtaccgtagaacgtatttcgacgtagtgttattactgtcagtctagtagtaggattccacttacgtgttccggttcggaccgtaaagggacctaagggtaacgaaagttacggaaaacgtaacgttgggtacggtacttacggacctaaccgtcgttcgttaccgg

SEQ ID NO: 145422 - DNA, 518 bp, Homo sapiens
  misc_feature: GYAE6OF01EV2W6.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (445)..(445): a, c, t, g, unknown or other
  misc_feature (445)..(445): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccacctctcctgcagctccagccagaatatccagagctactacatagcctggtaccagcagaagcctggccaggcctcccaggttccnatctatgcgtcgggtcccagacgggccacgtggcactcccaagaccaggttcaggtggcgagtgggtctgggacagacttcactctcatcattagcagactggagcctagaagtattcgctagtgtattactgtcagcagtagtgtaagttcactntgtcgtcgaccgaaggacctaaggtacgaaagtcggaaacgacgtagtacggtctagaccactagtcgttacg

SEQ ID NO: 145423 - DNA, 855 bp, Homo sapiens
  misc_feature: GYAE6OF01B5BWD.21.4.A04.1.454.CMB.1.raw
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagacgccaccctctcctgcagctccagccagaatatccagagctactacatagcctggtaccagcagaagcctggccaggcctccgaggttccncatctatgcctcgggtcccagacgggccacgtggaccactcccgaggtacctaggtttaccaggtcgggaccgtaggttcggggtacgtaggggtaaccaacgggtaccctttcgaacccgtttcgttaccctaagttccgtaaacgttttaacgggaccgtaacggtaaccggttacggggaaccggttacccgttaaggggtaaaacgttaacggtttttacccgggaacgttaaacgggtttacggtttaaacgttttaacccgttcggttaaccggtaacggtaacccgttaagggttttaaacgggtaacggggtttaaaccggttttcccgtaaacccggttttaccgttacccggggttttacccgggttttaaccccgggggtaacccggtaaaaaaccggggggttaaacccggttaaaaacgggggtttaaacgggtaaaaaaccggttaaccggggtaaaaaaccgggttaaacccgggttagggtttaacccggggtacccgttaaccgggtaacccctaaaccggttaacgtttacccggtttaacccgg

SEQ ID NO: 145424 - DNA, 663 bp, Homo sapiens
  misc_feature: GYAE6OF01EGBRM.21.4.A04.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctcaggcaccctgtcttgctcgaggggaaancgccacctctcctgcagctccagccaagaatctccagacgcctaactacatacgcctaggtaccagcaagagccgtggccaggcctccgaggtttccncatctagtcgcgtcggtacccagacgggccacgtcggacacgtcccgaagacgtaggttacaggtcggactagggtcgggtcgtagggaacacggtcttccaacttcacgtacttctagtttacgacgtaacgtacggttggacgtaccgtaggttaaacgtacgtttaccggacgttagttacgttaactttacgtcggtacgacgtacgtacggttagtacggtaacgttaccgtacgttccgttacggttaccggttacggtaccggtaaacgggtaaccggtaaagggtaacggtaaacggtaacggaaacgtaacggttacggtacgggtacgtaccggtaacctaaccgttatccggtttacg

SEQ ID NO: 145425 - DNA, 723 bp, Homo sapiens
  misc_feature: GYAE6OF01CF9CN.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttattttacaaggtgtcagtgtgaggtgcagctggtggagtcgtgggggagtacgttggtccaggccgtgggacgggtccctaggacgtacctcgtccgtgtcgcagccctctgctattccaccttcagtcgaccacaaactagtcggacgtcggggtcccgccgacggcctaccggaaggggaacggggtctaggggaggttcgggggtccggtacccggttaagtttaaccggaaaagggtaaacgacttaaaacggaacgtttaacgaaggtaacaaggtaacgtaccgggcgtcggttacgtagggtaacggtaaacgggtaacggttaccaaccgtactaccgtaacgaaaggtacgaagtagtaacgttaacgaaacgtaacctactaacgttagtactactagaactaaagtagaaccgacgtaaccgtaacggaaaaccgacggaaccgaacgggtaccgttaagtacgttaagttcggtaaggtaagaaacggtaaaaggtagggtaggtagttagggttaggtagggttaacgcggttggtaaccgg

SEQ ID NO: 145426 - DNA, 525 bp, Homo sapiens
  misc_feature: GYAE6OF01E10JR.21.4.A04.1.454.CMB.1.raw
  modified_base (200)..(200): a, c, t, g, unknown or other
  misc_feature (200)..(200): n is a, c, g, or t
  modified_base (489)..(489): a, c, t, g, unknown or other
  misc_feature (489)..(489): n is a, c, g, or t
  modified_base (519)..(519): a, c, t, g, unknown or other
  misc_feature (519)..(519): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccaccctctcctgcagctccagccagaatatccagagctactacatagcctggtaccagcagaagcctggccaggcctcccaggttcctcatctatcgcgtcgggtcccagacggccacgtggcatcccagacaggttcagtggcaggtgggtctgggacagacttcactctctatcattagcgtagacgtggacgtccgtagaacgtatttcgctagttgtattactgtcacgatagtataggtacgttctacttctcgtcgttcggacgaacgggactaagggtanaaagtagaaacgagtggcgtcagaccactntcgtcg

SEQ ID NO: 145427 - DNA, 740 bp, Homo sapiens
  misc_feature: GYAE6OF01ED1OF.21.4.A04.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctaccgaaggggaaanctcccaccctctcctgccagcctccagaccaagtaaactactccaagacgacctaactacatacgcctaggtaaccagaccaaggaacgccgtagggacccaggtccctaccccgtaggtttcccactactaccttacgtcggccgttaccggggtaccccaaggacgggacccacgttcgggacctacgtccccgaaggtaccgtaggttaccagggtcggacgtagggtcgggtacgtaggggaactacgtaccgtttcacgttaccttacgacttacgtaacgttacgacgtaacggtaacgtaggaccgtacgtaggtaacgttacgtttcgtacgtagttacgtttaacttacgttacgtacgaacggtacgttaagttacgtaagggttaacgtttacccgtaccgtttcgttaccggttcggttaaccgggacccgtaaacggggtaaccgtaaagggtaaacgtaaacgtaacggtaaacggtaacgttacgggtacggtacgtacgacctaacgtcgttcgtaccgg

SEQ ID NO: 145428 - DNA, 637 bp, Homo sapiens
  misc_feature: GYAE6OF01ATZZ0.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtcctccaggcaccctgtctttgtctccgaggggaaancgccaccctctcctgcagctccagccagaatatccagacgctactacatacgcctaggtaccagcaaggaagccgtggaccaggcctccccgaggttccctcactctagtcgcgtcgggtcccacgacgggcccacgtggaccacgtcccgaagaccgtacggttcagggttcggacgtagggtcgggttacgtacggggacctagtaccgtttcaacctcctacactctaacgttacgacgtaacgtacgtagggacgtaccgtagtaacgtattttacgacgtaattacgttaattacgttcgtacgaagtactaactacgtcgtacccttacccacccccgtactaccgtacccgttaccggaccgaaggtaccacgtactacgacgacgaacgtaagaaacgtacgtacggagtaccgtagtccgtaaccg

SEQ ID NO: 145429 - DNA, 567 bp, Homo sapiens
  misc_feature: GYAE6OF01C3HWF.21.4.A04.1.454.CMB.1.raw
  modified_base (199)..(199): a, c, t, g, unknown or other
  misc_feature (199)..(199): n is a, c, g, or t
  modified_base (372)..(372): a, c, t, g, unknown or other
  misc_feature (372)..(372): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccgaggttcctcatctatgcctcgggtcccagagggcccactggcatcccagacaggttcagtggcaggtgggtctggacagtacttcacttcncatcattagcagactggagcctagaagtactttcgactagttgtatttactgtacagtcagtagtggtaagttcctaccttcgttggttccggttacggtacgtaaacggggtaccgtaaagggttaacgaaaagttacggtaaaacgtaacgttagggtacgggtaccttaggacctaacctagttcgttacgg

SEQ ID NO: 145430 - DNA, 554 bp, Homo sapiens
  misc_feature: GYAE6OF01CQEW1.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (309)..(309): a, c, t, g, unknown or other
  misc_feature (309)..(309): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatanccagagctactacatagcctggtaccagcagaagcctggccaggcctccgagttcctcatctatgctgggtcccagnggcccaactggacactcccaagaccgtaggttcaaggtggactaggtgggtcngggaacaggtacttcactcctanatcattagcagactgganacctgaatagttcgntagtntattacgtgtacagactagttaagtggtattccgaccttgtcgttcggttccggaccgtaagggaacctaaagggtaagtaaagtacggaaaacgtaacgtggtacggctacggacaccgtattcgttacg

SEQ ID NO: 145431 - DNA, 795 bp, Homo sapiens
  misc_feature: GYAE6OF01BFHHP.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccagcaccctgtctttgtctccgaggggaaancgccaccctctcctgcagctccagccaagaatactaccagacgtctaactacatacgccgttaggtaaccagacaaggaacgtcccgtgggaccgaaggcccttaccccgtaacgggttttcccctactaacttccttaagtcggtccgttccgggtaccccaacggaccggggccctacgtcggaccaacgttccccgaaggtaccgtaggttacgacgggtcggaccgtagggtttcggggtaccgtaggggaacctacggtaacctttccgaaccgttctacgtaacgttactaacgtttacggaccgtaacggtaccgtagggtaaccgtaccgttaggaaacggttacgtttaccggaacgttaggtttacgttaacgtttacgtacgggttaccgaaggtaccgtaaggtttaacgtacgggtttaaccgttacccgttaaccgttcgttaccgggtttaccgggttaccgggtaacccggtaaacggggtaaacccgttaaagggtaaaccgtaaagttaaccgggtaaaacgttaaccggttggtacggtaccgtacgtaaccctaacgttcgttcccgtttaccgg

SEQ ID NO: 145432 - DNA, 747 bp, Homo sapiens
  misc_feature: GYAE6OF01C568P.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagcgccaccctctcctgcagctccagcccagaatatccagagctaactacatacgcctggtaccagcagaagcctggccaggcctcccaggttcctcatctatgcgtcgggtcccagacgggccacgtggccactcccagacaggttcagtcggcaggtgggtctggggacagtacttcacttctctatacctagtttacgacgtacgacgttcgggacgtaccgtagtaacggtagtttttacggaccgtaggttgttaacgttttaaccgttacggttaccgtaacggtacgttaaacgggttagtttaacggggttaaacgttttacccgtaacccgttttaccggtttaccgggttcccgggttttacccggggtaacccccgggttaaaacgggggtaaaccccgtaaaaaggggggttaaaaccgttaaaaaacgggtttaaccgggaaaaaaaccggttaaacccggtttaacggggttacggggtaacccgtttaccgggtaaccctaaacccccgttaaggtttcccggttttaacccgg

SEQ ID NO: 145433 - DNA, 703 bp, Homo sapiens
  misc_feature: GYAE6OF01AYSYZ.21.4.A04.1.454.CMB.1.raw
  modified_base (194)..(194): a, c, t, g, unknown or other
  misc_feature (194)..(194): n is a, c, g, or t
tcagtcgtcgctcgcacgaccggtgctcgatttagagtagtgatcaggggagacctgctcagttaggacccagagggaaccatggaaaccccagcgcagcttctcttcctcctgctactctggctccaggctcagaaaccacggagaattgtgttgacgcagtctccaggcacctgtcttgtctcgaagggaancgccacctctcctgcagctccagccagaatactccagagctactacatacgcctaggtaccagacagaacgcctggccaggcctcccgtaggttcctcattctagtcgcgttcgggtacccacggacggccacgtcggaccacgtcccgaggtacctaggttccaagggttcggacgtagggttcgggtccgtacggggtactaacggttacctttaccgaccttaccttacgtaacgttcctaacgtttacggacgtaacgtacgtacgggtacgtaccgtaaggtaacgttacgtttcgaacgttaggttcgttaatttaccgtcgtacgtacgtacgtaacgttacgtacggttaacgtttccaccgtttcgttacggttccggtttaccgggaaccggtaaagggtacccgtaaagggttaacgtaaacggttaaccggaaaacggtaaccggttcggtaacgggtaccttacggacctaaccgttacgttccgttcgttaaccg

SEQ ID NO: 145434 - DNA, 738 bp, Homo sapiens
  misc_feature: GYAE6OF01DSPG0.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggcaccctgtctttgtctcgaggggaagcgccaccctctcctgcagctccagccaagaatactccagacgctaactacatacgcctggtaaccagcaaggaacgccgtggcccaggtcctacccgtaggttccctacatctagtcgccgttcggacccacgaccgggcctacgtcggacctacctaccccgaagaccgtacggtttaccgaagggttcggacgtaggggtttcgggtaccggtaggggaactacggtacctttacccacgtttactaccgtaactttacgtaacgtttacggaccgtaacggtaaccggttacgggaaccgggtacccgttaagggtaaacggttacgttttacggaccgtttaagggtttactttaacgtttacgtttacggtcaacggttcgtaaggttaggttacggtaaacgtttccctaacccggtttcgttacggttccggttaccggaacccggaacgggtaaacggtaaaggtaaacggaagtaacggaaacggttacgtggtacggtacgtacgaaccctaccgtagttccgttacg

SEQ ID NO: 145435 - DNA, 755 bp, Homo sapiens
  misc_feature: GYAE6OF01BRTKD.21.4.A04.1.454.CMB.1.raw
  modified_base (292)..(292): a, c, t, g, unknown or other
  misc_feature (292)..(292): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggacgggtccctgagactctcctgtgcagcctctgcattcaccttcagtgaaccacaacngtcggacgtgggtccgccgaggctaccggaggggaacggggctgggaggtcggggtccggaccggttagttaacgaaaggaaacgtctaaacgtacggttaacaaggttaacgaaggaacgtacggggccgtcggtacgtagggtaaggaaaaggggtaacggttaccaaccgtatacgttaacgaaaggacgtaagttaggtaacttaacgaaaacgtaacttaccaacgttaggttaacttccgtaagtaacgtaaagttacggaaaccgacggtaaccgtaaaccggaaaaacccgggacgggaacccaaccgggggttaccgttaaggtttaacgttttaacggtttaaggggttaacggggttaaaaggtaaaacggtaaaaaagggttaggggttaacgggttaaggtttcggggttaagggggtttaagggttacggtaggttacgggtaacccgg

SEQ ID NO: 145436 - DNA, 762 bp, Homo sapiens
  misc_feature: GYAE6OF01CPKTG.21.4.A04.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccaccggagaaattgtgttgacgcagtcctccaggcaccctgtctttgctaccgaaggggaaancgcccaccctctcctgctagcctccagaccaagaactactaccgaagacgtcctaactacaacgttacgcccgttagggtaacccaggaccgaaaggtaaaccggtcccgtacggggacccaacggggtccccttaccccgtaagggtttcccctacgtaactttaccgtacgtcggtccgttccggggtaccccaacggtacgggccctaacgtcggacctacgtaccccgaggtaacctacgggtttacaagggttcggaccggtagggttacggggtccgtaggggaacctaacggttacctttaccgaccttccgtactaataccgtaagttaacggacgtaacgtacgtacgggactaccgttaagtaacgttcgttaccgagtacgttagttaactttacgtacgtacgtagacgtaaggtacgttaaggtacttccgtaacttcgttcggttaccggttacggaaccgtaacgggaacgtaaagggtaagtaaacggtaacgtaaacggtacgttaggtacggtacctaacgacctaacctgttcgttacg

SEQ ID NO: 145437 - DNA, 551 bp, Homo sapiens
  misc_feature: GYAE6OF01D0K3D.21.4.A04.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaangccacctctcctgcagctccagccagaatactccagacgctactacatacgcctggtaccagcaagaacgcctggccaggctcccaggttccnactctagtcgcgtcgggtcccacgacgggccacgtggccacgtcccgagactggttcagtggctaggtggtctgggacagtaccttcacttctacatctaattagcagtactggacgtccgtagacgtatttcgctagttcttacttcgtgtcacgtcgtagtagtaggtacgttcactcgtgtccggttcggaccgtaacgggacctaaaggtataaacgtcggaaacgtagtggtacgtctacgaccactatcgttacg

SEQ ID NO: 145438 - DNA, 684 bp, Homo sapiens
  misc_feature: GYAE6OF01CYFG7.21.4.A04.1.454.CMB.1.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctccgaggggaaanagccaccctctcctgcagctccagccaagaatatccagagctaactacatagcctggtaccagcagaagcctggccaggcctcccgaggttccncatctatcgcgtcgggtcccacgacgggccacgtcggacactcccaggacctaggttcaggtcggcgaggttgggtactggggacagtaccttcgacctctcatcattacgcgagtacgtggacgtaccgtaggtaacgtacgtttcgacgtagttagttaactttacgttaggtaccgtaaggtaccgtaagggttaacgttacggggtaaacgtttcccgtaacccgtttacgttacgggtttacccggtttaccgggtaacccggtaaaacgggggtaacccgtaaaaggggttaaacgtaaaaggttaaccgggtaaaaaccggttaacggttagggttacgggtaccgttacggaacccgtaacccgtaacggttcccgttaacgg

SEQ ID NO: 145439 - DNA, 542 bp, Homo sapiens
  misc_feature: GYAE6OF01AQKUX.21.4.A04.1.454.CMB.1.raw
  modified_base (211)..(211): a, c, t, g, unknown or other
  misc_feature (211)..(211): n is a, c, g, or t
  modified_base (386)..(386): a, c, t, g, unknown or other
  misc_feature (386)..(386): n is a, c, g, or t
  modified_base (446)..(446): a, c, t, g, unknown or other
  misc_feature (446)..(446): n is a, c, g, or t
  modified_base (461)..(461): a, c, t, g, unknown or other
  misc_feature (461)..(461): n is a, c, g, or t
  modified_base (536)..(536): a, c, t, g, unknown or other
  misc_feature (536)..(536): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagcgtggtttcgtgtggtatttacaagtgtcagtgtgaggtgcagctggtggagtctgggggganacttggtccagccgtgggaggtccctgacgctctcctgtgcagcctctgcattcaccttcagtgaccacaacatggacttgggcccgccaggcctccgaggggaagggctgggagtcgggtacggccgttatacgaaggaaagctaaacagttacagtacagaatacggcgcgtnggtagaaacggaggttccaacatctcgaaagagtatagattacaaaagaacctcgctagnttcagacaatagaanagacctacaaacgaagacgaacggcgtagtattagttagtggtagaagaaagaagtaggagtagtggtaggtagngtgtag

SEQ ID NO: 145440 - DNA, 890 bp, Homo sapiens
  misc_feature: GYAE6OF01AN9EW.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggaggaggctgctcagttaggacccagagggaaccatggaaacccagcgcagcttctcttcctcctcgctactctggctcccaggctcagaaaccaccggagaaattgtgttgacgcagtctccaggcaccctgtctttgctcaggggaaancgccacctctcctgcagcctccagaccagaactcgtccagagctaactacatacgcctacggtaaccagccgaagtaacgcccgttacgggaccctaagggcccgttacccccgtaacggggttttacccctaccgtaaacgtttccgttaaacggtccggtttcccgggtaccgggggtttaccccccaaccgggtaaccggggggcccctaaccggttcgggaccctaacgttacccccgaacgggtaaccgttacgggtttaccgaacgggttcggggacccgtagggggtttacggggtttccggtaacggggggtaaccctaaacgggttaccccttttacgggaaccctttacccgttccgtaaacgtttcccgtaaaggttttaccggaaccgttaacggtaacgggttacgggtaacggtacccgttaaggtaaaccgggttaacttttccggtacgtaaaggtttcggttaaactttccggttaggtaaccgaggtaccgtaggtttaacggtacggggttaaaccttttccgaacccgtttaccgggttgttaccggggtttacccgggaacccggtaaacgggggttaaaccgttaaacgggaaaaggttaacctaaacggggtaaacccgttaacgttgggaacggttcgtaccgaaccggtacctagttaccgttcg

SEQ ID NO: 145441 - DNA, 519 bp, Homo sapiens
  misc_feature: GYAE6OF01B2FRO.21.4.A04.1.454.CMB.1.raw
  modified_base (200)..(200): a, c, t, g, unknown or other
  misc_feature (200)..(200): n is a, c, g, or t
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
  modified_base (513)..(513): a, c, t, g, unknown or other
  misc_feature (513)..(513): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgaagaaattgtgttgacgcagtctccaggcaccctgtctttgtctccaggggaaanagccaccctctcctgcagctccagccagaatatccagagctactacatagcctggtaccagcagaagcctggccaggcctcccaggttccctcatctatcgctgggtcccagacgggcccacgtggcactcccagacctaggttcagtggcaggtgggtctggggacaggactttcactctcatcattagcagactggacgcctagaagtntttcgctagtgtattactgtcagctagtatggtaattcactntgtcgttcggaccgaggaccgaaggtagaagtagaaacgtactaggtggtctagacactntcgtcg

SEQ ID NO: 145442 - DNA, 719 bp, Homo sapiens
  misc_feature: GYAE6OF01COLHR.21.4.A04.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagctccagccaagaatatccaganctaactacatagcctggtaccagcagaacgcctggccaggcctccgaggttcccngactctagtcgcgtcgggtcccagacggggcctacgtcggccacgtacccgagtacgtacggtttcgaggttcggaccgtagggttcgggtccgtaggggaacctaggtacccttttcgaacgtttcctacgtacttacgtaacgtttacgacgtaacggtaccgttacgggtaacgtacccgttaagtaaacggttacgttttcggacgtagttacgttaactttacgtagtacgtaaggtacgtaaggttacgtacgggtaacgtttaccgtaccgtttcggttacggttacccggttaccgggaacccggtaaaacgggggtaaccgtaaaacggggttaaacgaaaacggttaacgggaaaaccggttaccggttaggttacggtaccgttacggaacctaccgtagttccgtttaccgg

SEQ ID NO: 145443 - DNA, 562 bp, Homo sapiens
  misc_feature: GYAE6OF01BNABD.21.4.A04.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (284)..(284): a, c, t, g, unknown or other
  misc_feature (284)..(284): n is a, c, g, or t
  modified_base (391)..(391): a, c, t, g, unknown or other
  misc_feature (391)..(391): n is a, c, g, or t
  modified_base (491)..(491): a, c, t, g, unknown or other
  misc_feature (491)..(491): n is a, c, g, or t
  modified_base (555)..(555): a, c, t, g, unknown or other
  misc_feature (555)..(555): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttcctgttgttattttacaaggtgtccagtgtgaggtncagctggtggagtcgtggggganacttggtccagcctggagggtccctgagactctcctgtgcagcctctgctattcaccttcagtgacctanaactagtcggactcgggtccgccaggcctccggagggagggctggaggtcgggtcgcgtattacgaaggaacgtctaagagttacagtaacagaatacggcgtcgtntgtagaaagggacgttcaccgatacgtacaagagatagaacttacaaagacctcaatgtactcagacaaatacgaacacggtaccctaacggaaaaccgnggaacaccggtcgtacttagtacgttggagtaagtaacaaaaggcgtaggatcggtggtagtangtgtacg

SEQ ID NO: 145444 - DNA, 609 bp, Homo sapiens
  misc_feature: GYAE6OF01AO0QV.21.4.A04.1.454.CMB.1.raw
  modified_base (200)..(200): a, c, t, g, unknown or other
  misc_feature (200)..(200): n is a, c, g, or t
  modified_base (448)..(448): a, c, t, g, unknown or other
  misc_feature (448)..(448): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanagcccaccctctcctgcagcctccagccagaactatcccgaagagctactacatacgcctggtaccagcagaacgcctggccaggcctccccgaggttccctcattctatcgccgtcgggtacccacgacgggccacgtggccacgtcccgagacgtaggttcaggtcggcgtaggtgggtctaggggactagtaccttcgacttctcatcaattacgctagacgtggacgtcgtagaagtcttacgntagtagttacttacgtgtacgagtacgtaagtagtaggtacgttctaccgttcgttacgtccggttacggaccgaaacgggtaaccgtaaagggtaacgtaaagtaacggtaaaccgtaacgtaggtacgggtactacggacctaaccgtgttccgttacg

SEQ ID NO: 145445 - DNA, 785 bp, Homo sapiens
  misc_feature: GYAE6OF01CV73F.21.4.A04.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
tcagtcgtcgctcgcacgaccggtgctcgatttagagtagtgatcagggggagagctgctcagttaggacccagagggaaccatggaaaccccagcgcagcttcctcttcctcctgctactctggctcccaggctcaagaaaccacggaagaaattgtgttgacgcagtctccaggccacctgtctttgtctaccgaaggggaaanacgccctaccctctcctgcagcctccagaccaagaatacnccgaagacgctaactacatacgcctaggtaaccaggacaaggaacgccgtcggaccgaggtccctcccgtagttttccccactaacttcttaacgtcggtccgttacgggacccaacggacgggtacccacggtcggacctactacccgaaggtaccgtaggttcgagggttgggacgtagggtcgggtcgtagggaacctagtacctttacaccttctaccgtaatacgttaacgttacggaaccgtaaggtaaccggttcggggaaccgttaccgttaaagggtaaacgtttacgtttacggtaccgtaagggtttacgtttaacgttaacgtttgtaccgtaacggtaacgttaaggttaacgtaagggtaaccgttttacccgtaacgttccgggttaccggttaccggttaacccggggaaccggttaaaacggggaacccgtaaaaggggtaaacttaaaacggtaacggtaaaaccggttacggttacgggtacggtaccaccggtaacctaaccgttcgttccgtttaccg

SEQ ID NO: 145446 - DNA, 686 bp, Homo sapiens
  misc_feature: GYAE6OF01D2ABF.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggccacctgtctttgctcgaggggaaangcccacctctcctgcagcctccagccagaatatccagagctaacacatacgcctggtaccagccagaacgccgtggaccgaggccctcccgaggttccctacagttcctagtcggacctcgggtacccagacgggccacgtggctaacgtcccaggactaggttcaggtcggctagggtgggtccgtagggaactacgtaccttcgacttcgtactagtactaattacgacacgacggttaggaccgtacgtaggtaacgtagtttccggacttaggttacgttaacgttttacgtcggtaccgaacggtaccgtaaggttagtacgggttaaccgtttaccgtacccgtttacggttccggttaccgggttacccgggaaccggtaaaccgggtaaaccgtaaacggggtaaacggtaaaagttaacggtaaaaccggtacgttacgggtacggtacgttacggaacctaacctacgttccgttacg

SEQ ID NO: 145447 - DNA, 820 bp, Homo sapiens
  misc_feature: GYAE6OF01BL5Z5.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggatacttggtccagccgtgggacggtccctgacgactctcctgtgcagcctctgctattccaccttcagtcgaacccacaacagtcggaccgttcggggtcccgccgagggtcctaccggagggggaacgggctagggacggtggggtaccggtaccgttaagttaaccgaaaggaaacgtactaaacgtagttaacaaggttaccaaggaacgttacgggcgtacgtacgttaggtaacggaaaagggtacggtttcccaacccgtaagttcccgtaacgaaaaggtaaggtaacttacgggtaaacttttaaccgaaaaaaggtaacccttccgtaaacgttgttaaaccgttacccgtagaaacccgtaaaagttaccggaaaaccgtacggtaacccccgttaaaggggaaaaaacccccggtagggtaaccccgtaaacccggggttcccggtttaaagtttaaacgttttaacggtttacgggtaaaccggggttaaaacgaaaaaccggtaaaaaaggggttccgggttaaagggggttacttacggggggtttaacgggttaaggggttaaactcccgggtttaaagggtaaacccgg

SEQ ID NO: 145448 - DNA, 585 bp, Homo sapiens
  misc_feature: GYAE6OF01APS0L.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanagccaccctctcctgcagctccagccagaatatccagagctactacatagcctggtaccagcagaacgcctggccaggcctcccgaggttccctcactctagtcgtcgtcgggtcccacgacgggcccacgtcggcactcccgagacgtaggttacaggtggctaggtcgggtctgggacagtacttacactctactatcgtattacgacgtagacgtacggacgtccgtaggtaacgtacgtttcgactagttagttattacgtgtacagtcgtaagtagtacggtacttcacttcgtcgtcggtcgacgtaacggaccgtaaaggtacgtaaagtacggtaaacgtacgttggtacggtactacgaccacctagttcgttacg

SEQ ID NO: 145449 - DNA, 643 bp, Homo sapiens
  misc_feature: GYAE6OF01A1S2L.21.4.A04.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagcctccagccaagaatactccagacgctactacatacgcctggaccagcagacgccgtggccaggcctccgaggtttcccnctatctagtcgccgtcgggtcccacgacgggcccacgtcggctactcccgagacgtaggttcaggtcggcgtagggttgggtcgtaggggactacggtacctttcacttcctacatcgtagttacgacgtacgtacgtagggacgtccgtaaggtaacgttacgtttacgacgttagttacgttaacttacgtgtacgtagtacgtaaggttagtacgggtaacgttccgtacccgttgtaccggttccggttaccggaccggtaaacgggtaaccgtaaaggtaacgtaaagtaacggaaaccggtacgtaggtacgtacgtacgacctacgtagttcgtacg

SEQ ID NO: 145450 - DNA, 710 bp, Homo sapiens
  misc_feature: GYAE6OF01D9G9C.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaaanacgccaccctctcctgcagcctccagccagaatactccagagctactacatacgcctaggtaccagcaagaacgcctggaccaggcctcccgtaggtttccctacatctactcgcgtcgggacccagacgggccacgtcggaccactcccgaagacgtacggttcgaggtggacgtagggttcgggtactggggaacctaggtaccctttacgaacccttccttaccgtaattaccgtaacgtttaacgacgtaacggttacgtacgggaacgtaccgtaaggtaacgttacgtttacgacgtaggttacgttaactttacgtacgttacgacgtacgtaaggttacggttacgggttaaccgttaccgtaccgttacgttccgggttaccggttaacccgggacccggttaaaccggggtaaaccgtaaacgggttaaacgtaaacggtaacggtaaaacgtacggttagggtacggtaccgtacggtaaccaaccgttgttcgttaccg

SEQ ID NO: 145451 - DNA, 832 bp, Homo sapiens
  misc_feature: GYAE6OF01CNVZE.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcggtgggggagacgttgggtccaggccgttgggacgggtccctggacgacttctccgtgtgcagtcctctgctattcaccttcagtgaacccacaacagttcggactcgggtcccgccgaggtcctaccggagggaacgggggctagggaggtcggggtccggacccggttaagttaacgaaaaggaaacgacctaaacgaggttaacaagtaaccgaaggtaaacgttaccgggccgtacggttcgtagggtaagggaaaacggggtaacgggtttaaccaacccgtaacgttaccgtaacgtaaaacggtaaaggtaacgtaaggttaactttaaaccgaaaaaccggtaaccttaaccgaaacgtttagtaacgttccgttaacgggaacctaaaaagttacgaaaaccgaaccggtaacccgtaaaaccgggaaaaacccgggtaacggggaaacccgtaaccggggtaacccggttacggttaaacgttttaacggtttacggggttaaacggggttaaaacgggtaaaaaccggttaaaaaaggggtacgggttaaaggggtagtttaaggggggttaggggttaaggggttaaccgggtcgtttacggggtaaaccgg

SEQ ID NO: 145452 - DNA, 773 bp, Homo sapiens
  misc_feature: GYAE6OF01B1E0W.21.4.A04.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggcaccctgtctttgtctccgagggaagcgccaccctctcctgcagcctccagccaagaatactccagacgctaactacatacgcctaggtaccagcaagaacgcctaggccaggcctccgaggttcctnactctatcgctcgggtcccacgcgggaccacgtcggccacgtcccgaagtaccgtacggttacagggtcgggacgtagggtcggggtacgtacggggaactacgggtacctttaccgaaccgttcctaccgtaacttaccgtaacgtttaacggaccgtaacggtaaccggttacgggaaccgtacccggttaaggtaaacggttaccgtttaccggtacgttaacggtttaggtttaactttacggttacgtaccgtaacggtaccgttaaacggttaggtttaacggggttaaaccgttttacccgtaacccgtttcggtttaccggtttacccgggttaccgggaacccggtaaaacggggtaaacccgtaaaggggttaaacgtaaaggttaaccgggtaaaaccggttaaccggttaaggttacgggtaccgttacggacccgttaacccgttagttcccgtttaccg

SEQ ID NO: 145453 - DNA, 743 bp, Homo sapiens
  misc_feature: GYAE6OF01C010A.21.4.A04.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (598)..(598): a, c, t, g, unknown or other
  misc_feature (598)..(598): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccacggagaaattgtgttgacgcagtctccgaggccaccctgttctttgctaccgaagggaaancgcccacctcncctgcacgctccagacctaagaatacgccaagactaccttaactacacgtacgccttacggtaaccaggacaaggaacgtcccgtcggacccgtagggtccccttacccggtaacggttccctactaacgtccttaagtccggtaccgtccgggtacccaacggacgggccctaaggtcggacctaccgtacccgaaggtaccgtacggttcaacgggtcggaccgtagggtcgggttacaggggtaactaaggtaccctttacacctttccagtacttactaaacggttacggaccgtaaggtacggtacggtaaccgtaccgttaaggtaagtacgtttccggattaacgggtttattaccgtaacgtggtaccgacgtntaaggtttacgtagggtaaacctttccaccgttcgttacggtaccggttaccggaacggtaaacgggtaaccgtaaaggtaacgtaaaattacgggaaaacgtacggttggtacgtaacgtcgaaccacgttacgtccgtttacg

SEQ ID NO: 145454 - DNA, 661 bp, Homo sapiens
  misc_feature: GYAE6OF01DDEFI.21.4.A04.1.454.CMB.1.raw
  modified_base (210)..(210): a, c, t, g, unknown or other
  misc_feature (210)..(210): n is a, c, g, or t
  modified_base (316)..(316): a, c, t, g, unknown or other
  misc_feature (316)..(316): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcttgttgttatttacagtgtcagtgtgagtgcagctgggtggagtcgtggggganacgttgggtcccaggcctgggacgggtccctggacgacctctcctgtgcagcctctgctatttccaccttcagtcgaaccaacaactagtcggacgtcggggtccnccgagggcctccggaaggggaggggctgggaggtcgggtaccggtaccgtattaacgaaggtaaacgtctaaacgagttacaagtaacagtaacgacgggcgcgtacgtaggaggaaagggtaacgtttccaaccctaagttccaagaagagtagttagattaacgaaagtacctgaacttgtaactcgtagaacgtaaatccgaaacgtacgtaccgtaaacggaaaaccgcggaaccgtaccggtacgtttaagtagtttaggtacggtaaaggtaaagaaaacggttaaaaggtgggttagtaggttacgggttagggtacgtaacggtgttaggtaaaccg

SEQ ID NO: 145455 - DNA, 747 bp, Homo sapiens
  misc_feature: GYAE6OF01ALKFZ.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangcccaccctctcctgcagcctccagccagaactactccagacgcttaactacattacgccctaggtacccaggcaaggaacgcccgtgggacccaagggtcccttacccccgtaagggtttcccctactaacttcctaagtcggccgttcggggtacccccaacggtacggggcccaacgttcgggacctacgttcccccgaagtaccgtaacgggtttccaagggttcgggaccgtagggtcggggttacctaggggaccacggtacctttccgaccttcgtactagtactaagtttacgacgtaacggtacgttagggacgtaccgtaggtaacgtacgtttacgacgtaggttagttaactttacgtgtaccgagtacgtaaggttacgttacgggtaacgtttccgtaccgtttcgttccggttaccgggttaccggaacccggtaaacggggaacccgtaaaggggtaacgtaaacgttaacggaaaaccggtaacgttacgggtacggtacgttacggacctaacccgtagttccgttacg

SEQ ID NO: 145456 - DNA, 615 bp, Homo sapiens
  misc_feature: GYAE6OF01DQDE9.21.4.A04.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (456)..(456): a, c, t, g, unknown or other
  misc_feature (456)..(456): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaanctccaccctctcctgcagcctccagccagaatactccagagctactacatagcctggtaccagcaagaacgcctggccaggcctacccgaggttccctnattctatcggcctcgggtcccacgagggcccagtggccatcccagactaggttcaggtggctaggtcgggtctgggaacaggtaccttcgaacttctactatcgtaattagcctaagacgttaggacgaccgttaggaagttatttacggctaaggttnttactttaacgtgtacacggtctaaggttacgtagggtaacttcctaccgttcgttcggtccggttacggaccggaaacggggtacctaaaggggttaacaaaacggttacggaaaacgtaacgtggtacgtacgtacgacctaaccgtgttcgttacg

SEQ ID NO: 145457 - DNA, 595 bp, Homo sapiens
  misc_feature: GYAE6OF01ER7RA.21.4.A04.1.454.CMB.1.raw
  modified_base (586)..(586): a, c, t, g, unknown or other
  misc_feature (586)..(586): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttttctccagggaaaggagccaccctcctcctcgcacgctccacgaccacgaatatccacgagctactacatagcctcggtaccacgacagaacgacctcggccgacggccgtccccacggttccgttccatctatgccgtcgggtcccgaccgacgggccgactcggcactcccgacgacaggttcagtcggcgagtgggtcgtcgggacgagtacttctactctcatctaattagccagacgtgggacgcctagaaagtctttcgcgagttgttacttacgtgtccagacagttaagtcggtaacgttcaccttcgttggtaccgttcggaccaaggggtaccaaaggttaggaaactaggaaacggtaacgttggtggacgttacacgaaccctaacgttntggttaccc

SEQ ID NO: 145458 - DNA, 660 bp, Homo sapiens
  misc_feature: GYAE6OF01DDZ1I.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcacctgtctttgctcgaggggaancgccacctctcctgcagctccagccaagaatactccagacgctactacatagcctggtaccagcaagaacgcctggccaggcctcccgaggttcctcattcctagtcgccgttcggggtaccccacgacggggcccacgttggaccctaacttccccgaagaccgtagggtttccagggttcgggacctaggggttcgggttcgtacggggaaccaggttaccttcgacttctacattctaacttacgacgtacgaacgtgggacgtaccgttaggaacgttactttcggtactaaggttacgtttagtttactcgtactagtacgtaaggttagttagggtaacgttcctaccgttcgttcggttccggttacgggaccggtaaacgggtacctaaacgggtaacgaaagttacggaaaacgtacgtaggtcggtacgttacgactaaccgtagttcgttacg

SEQ ID NO: 145459 - DNA, 683 bp, Homo sapiens
  misc_feature: GYAE6OF01C2MT6.21.4.A04.1.454.CMB.1.raw
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggaagaaattgtgttgacgcagtctccaggcaccctgttctttgctaccgaaggggaaacgcgcccaccctctccgtgcagcctccagccaagaatacnccgaagacgctaactacatacgcctaggaccagcaagaagcctggccaggcctccgaggttccnatctatcgctcggccacgnggcctacgngacactcccgaagacgtacggttcaagtcgggactaggggttcggtcgtacggaactaacggtactttaccgatttccgactaaacttcgtaacgttaacgacgaacggtaaccgttgggaaccgtaccgtaaggtaaagtacgtttaccgaagttagttacgttatttacgtagtacgaagtagtaacgttagtaacggtaacgttaccgtaaccgttcgtacgggttaccgttaccgggaaccggtaaaacgggtaaaccgtaaagggtaaacgtaaaagtaacggtaaaacggtacgttagggacggtacccgtagaaccgtaacccttaagtcccgtttaacg

SEQ ID NO: 145460 - DNA, 567 bp, Homo sapiens
  misc_feature: GYAE6OF01AWJTI.21.4.A04.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
  modified_base (428)..(428): a, c, t, g, unknown or other
  misc_feature (428)..(428): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanagccaccctctcctgcagctccagccagaatatccagagctactacatacgcctggtaccagcagaagccgtggcccaggcctcccgaggttcccnatctatgtctcggtcccagacgggccactcggcactcccagactaggttcaggtgcgaggtgggtctgggacagaccttcactctcgatcattgcagacgtgacgtccgtaggaagtagtttcgctaggttnttaagttactgttacagtctaagttagtaggtaagttccacgttcgtcgttaccggtccggtaccgaaacgggaccgtaaagggtaagtaaagtaggaaaccgtaagtggtacggtctacggacacctagtccgttacg

SEQ ID NO: 145461 - DNA, 797 bp, Homo sapiens
  misc_feature: GYAE6OF01A50VW.21.4.A04.1.454.CMB.1.raw
  modified_base (213)..(213): a, c, t, g, unknown or other
  misc_feature (213)..(213): n is a, c, g, or t
tcagtcgtcgctcgcacgaccggtgctcgattttagagtagtgatcaggggagagcgtgcgtcgacgttaggaccccaggaggtaaccagttggtaaccccagtcgcagcttcgtcttcctcctgctactctgcctccaggcttcgagaaccgaccggagtaatttgtgttgacgtactaagtctccagtcaccgtgtcttgctcgagggaancgccgaccgtctccgtgcggacgggtccctcgagaccgagtaacttagtccgacgagccttaacgtacgaattaccgtacctttaggaccctaacgtccaagtaaaccgtccgtaggaccgtacggtcccgttaccccggtacggttaccgtaccgtaacgttacgggttaggtccgtccggttcgggttaccccgaacgtaccgggacctacgttaggacctaaccgtacccgaggtaacgtaaggttacgacggtacggaccgtaggtcggttacgtacggtacgtacggtaccgttccgtacctacgttaccgagttaccctaagttacgacctaacgtaccggtaaggaaccgtaccggtaagtaaccgttaccgtttcggaaacgttaacggttaacgttaaccgtttaacgtccggttaaggaacgtaccgtaacggttaaccgtagggttaaacccgtttacttaccgtttaggtccggttaccgtaccggtaaccgtaacgggtaaaccttagggaacgtaaagttacggaaacccgttatggacgtactagtaccgtaccgttagtcccgttacg

SEQ ID NO: 145462 - DNA, 619 bp, Homo sapiens
  misc_feature: GYAE6OF01CPUL8.21.4.A04.1.454.CMB.1.raw
  modified_base (206)..(206): a, c, t, g, unknown or other
  misc_feature (206)..(206): n is a, c, g, or t
  modified_base (289)..(289): a, c, t, g, unknown or other
  misc_feature (289)..(289): n is a, c, g, or t
  modified_base (400)..(400): a, c, t, g, unknown or other
  misc_feature (400)..(400): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccaaccggagtaaattgtgttgacgcagtctcaggccaccctgtctttgtctaccgaaggggaanacgccaccctctcctgcagcctaccagaccaagaatacaccagacgctaactacatagccttaggaccaggcaagaacgtccnggccaagggcctcccgaggttccctacaagttccagtcgacgttacggggtaccccaggacgggcctacgcggactactccgaagactaggtcaggtcgactaggtggtcnggacacgtctttcgacttcgaactgtactaacgttcgacgtagaccgtggacgtaccgtaggaagttctacggactagtacgttattagtgactagactagtagtaggtacttcacgttgtcgtaccggttcgaaccggaaaggtaccgaaagggttaaagaacgtaacgaaaaccggtagttcgacggtcctaagtacccgaactcgttgttacccgg

SEQ ID NO: 145463 - DNA, 618 bp, Homo sapiens
  misc_feature: GYAE6OF01A8N57.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccaccctctcctgcagctccagccagaatatccagagctactacatagcctggtaccagcagaagcctggccaggcctcccaggttcctcactctatgctcgggtcccacgagggccacgtggcactcccagacaggttcagtcggcgagtcgggtctgggacagtacttcactctcgatcattacgcagacgtggacgcctagaagtatttcgacgtagtagttattacgttgtaccgtagaccgtaaggttagttacgggtaacgtttccgaaccgtttcgttacggttccggttaccgggtacccggtaaacggggtaacccgtaaagggttaaacggtaaaacgttaacgggtaaaacccgtaacgttacgggtacgggtacgtacggacctaacccgtagttccgttaccgg

SEQ ID NO: 145464 - DNA, 774 bp, Homo sapiens
  misc_feature: GYAE6OF01CQ0O5.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaggggaaancgccaccctctcctgcagctccagccagaatatccagagcctactacatagcctaggtaccagcagaacgcctggccaggcctcccgtacggttccctcacttctatcggtccgtcgggtccccacggacgggccctacgtcggaccacgtccccgaaggtaccgtacgggtttcgaagggttcgggccgtaaggggttcggggttccgtagggggaaccctaggtaccctttccgaccttccgtactacttacctaagtttacgacgtaacggtaccgtacgggtacgtacccgtaaggtaaacggttacgtttaccggtacgttaacggttacgtttaacgtttaaccgttacggttacgtaacggtaccgttaagggtttaacggttaacgggttaaccgtttacccgttaacccgttcggtttccggttaccgggttacccgggaaccgggtaaaaccggggtaaccgtaaaaggggttaaacggtaaaagttaaaccgggtaaaaaccgtaacggttacgggttacggtaccgtaccggtacccgtaaccgtacgtttcggtttaccg

SEQ ID NO: 145465 - DNA, 681 bp, Homo sapiens
  misc_feature: GYAE6OF01AH4SP.21.4.A04.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaaancgccaccctctcctgcagctccagccagaatcnccaganctactacatagcctggtaccagcagaacgcctggccaggcctcccgaggttccctcattctagtcgccgtcgggtcccagacgggcccacgtcgggccacgtcccgaagtaccgtaggtttcagggtcggcgtagggtcggggtctaggggaacctacgtaccgtttcaaccgttctacctagttaccgtaagtttacggacgtaacggtacgttacgggaacgtcccgttaaggtaaacgttacgtttaccggacgtaaggtttactttacgtttaacgtcggttacgaaggtctaaggttacgtagggttaacgttacctaccttcgtacggttccggttacgggaccgtaaacgggtaccgtaaagggtaacgtaaagtacgggtaaaacgtacggttaggtacggtaccgtacggaacctaccgttagttccgttacgg

SEQ ID NO: 145466 - DNA, 672 bp, Homo sapiens
  misc_feature: GYAE6OF01DMDQG.21.4.A04.1.454.CMB.1.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaattgtgtgacgcagtctcaggcacctgtctttgctaccgaggggaacacgcccaccctntcctgcagctccagccagaatatccgagagcctactacatacgcctaggtaccagacaagacgcctggacccagggtccctacccgtaggtttcccnctacttcgttaaggtccggacgttccgggtacccaacggcggtaccaggtcgactaccgtaccgagacgttcggttacgacggtggtccgtagggtcggtcggtacggactacggtacctcgtaactctactagtctaacgttacgacgtacggtacgtggaactccgtagggtaaccttgtttcgacgttagtacgttaactggtacgtacacgtaagtaccggttaagtacgggttatacccgttcgtacggttaccggttaccgggtaccggaagggtaaaccgtaaaagggaggtaaacgtaaaggtaaccgtacggttaacggcggttacgtaccgacgtaaccttcgtacgtcgttaacccg

SEQ ID NO: 145467 - DNA, 716 bp, Homo sapiens
  misc_feature: GYAE6OF01C8U8N.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctcaggccaccctgtctttgtctaccgaaggggaaanacgcccaccctctcctgcagcctccagccaagaatatccaagacgctaactacactagccctaggtaaccagacaagaagccgtggccacgggtcctaccccgaaggttccctacgatcctagtcggcgttcgggcccacggacgggcccacgtgggaccaacgtccccgaagtaccgtaagggttccaagggtcgggccaagggttcgggtccgttaggggaacctacggtaacccgtttacacgtttcctactattaccgtaagttacgaccgtaaggacccgtttagggaacgtacccgttaagggaaacggttacgttttccggacgtttaagttaacggtttaactttacgtagtaccgaagggtcctaaaggtttacgtaagggttaacgtttaccctaccgtttacgtcggtttcccgggttaacgggaccgaaaggggaaccctaaagggtaataaacggtagaaaaccgtacgttgggtcgtactagaccacctagtccgttacg

SEQ ID NO: 145468 - DNA, 590 bp, Homo sapiens
  misc_feature: GYAE6OF01ELCYN.21.4.A04.1.454.CMB.1.raw
  modified_base (422)..(422): a, c, t, g, unknown or other
  misc_feature (422)..(422): n is a, c, g, or t
  modified_base (466)..(466): a, c, t, g, unknown or other
  misc_feature (466)..(466): n is a, c, g, or t
  modified_base (548)..(548): a, c, t, g, unknown or other
  misc_feature (548)..(548): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcccgtgggacgggtccctggagactctcctgtgcagcctctgcattcaccttcagtcgaccacaacagtggactggggtcccgccaggcctccgaggggagggctgggagtgggtcggcgtatacgaaaggaagctaacagtacagtacagaactacggcgcgtctgtagaaaggtagttcacatctacaaganatgattacaaagactctactgtactctagactaaagtcgaaacngtaccctaacggaaaacccgaggaaccgaccgggtccttaggttaacgttagttcgggtaaggtaaagaaacgtaaaaaggnggtagggtaattgggtaggggttaggtaggtcgtgggtaacg

SEQ ID NO: 145469 - DNA, 722 bp, Homo sapiens
  misc_feature: GYAE6OF01BSFVR.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaancgccaccctctcctgcagctccagccagaatatccagagctacacatacgcctggtaccagcagaacgcctaggccacggcctccccgtaggtttccctcgacttctagtcgaccgttcggggtccccacgacgggcccacgtcggacctaccgtcccaaggtactaacggttcaaggtcggctagggtcggtcgtagggactacgtactttcaccgttctactacgttcgtaacgtttacgacctaacggtacgttagggaacgttacccgtagggtaaacgttacgtttaccggtacgtaacggtttcgttaactttacggttacgtaccgtaacggtccgtaaaggtttacggtacgggttaaccgtttaccgtaacccgtttcggttaccgggtttccggttacccgggaacccgggtaaacggggtaaacccgttaaagggtaaaccggtaaaggttaaccggtaaaccggtaacgttcgggtacggaccgttacgaccctaactcgttccgttacg

SEQ ID NO: 145470 - DNA, 714 bp, Homo sapiens
  misc_feature: GYAE6OF01AQQLG.21.4.A04.1.454.CMB.1.raw
  modified_base (148)..(148): a, c, t, g, unknown or other
  misc_feature (148)..(148): n is a, c, g, or t
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaaattgtgttgacgcagtctccaggccacctgtctttgtctccgaaggggaaancgccaccctctcctgcacgctccagccaagaatactccagacgactactacatacgcctaggtaccagcagacgccgtggaccaggcctaccgaggttccnatctagtcgcgtcggtcccacgcggccacgtcggacactcccgaagtacgtaggttcaggtcggacgtagggttcgggtacgtacggggaacctacggttactttacgaccgttctacgtaacttaccgtaagtttaacggacgtaacggtaaccggttagggaaccgtaccgttaaggtaaacgtttacgtttaccggacgttaggtttacgttaacgttacgttacggtacgtacgtacgtaaggttacggttacggttaacgtttccgtaaccgtttcgttacggttaccggttaccggaaccggtaaacggggtaaaccgtaaagggtaaacgtaaaacggtaacggtaaaaccggttaacgtacgggttacggtacgtacggtacctaacgttacgttccgttacg

SEQ ID NO: 145471 - DNA, 861 bp, Homo sapiens
  misc_feature: GYAE6OF01B90Q3.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaacccagcgcagcttctcttcctcctgctactctggctcccaggctcagaaaccaccggagaaattgtgttgacgcagtctccaggcacctgtctttgcctcgaaggggaaancgccaccctctcctgcacgcctaccagaccaagaactacgaccgaagtacgtacctaactaacgagtaccgtccgttacggaaccgagaccgaacggaaccgtccgtacgggacccgacggcccttacccggtacggtttccctacgtacttaccgttacgttccggtccggttaccggggtaccctaacgggaccgggtacccgtaccggttaccgggaccctaacccgtaccccggtaacggtaaccggttacgggttaccgaaggggtcgggaccggttaggggttcgggtaccggtacggaaacgtaccgttaccgttaccaacccgttcgtacgtaactacgtaagttaccggaacgtacggtacgttaggaaccgttacggtaaggtaacggttacgtttaccggtacgttaacggtttacgtttaacgttaaccggttggtaaaccgtacggttaaccggtaaagggtttacggttaacggtaaccggtttaccctacggtttccggtacggggtttaccccgggttaccgggtaaaccggtaaaccggggtaaaaccggttaaaggtaaacgggtaaaacggttaaccggtaaaccgggtacggttacgggtaacggttacggaccgtaaccgtacccgtgttaccgtttacg

SEQ ID NO: 145472 - DNA, 548 bp, Homo sapiens
  misc_feature: GYAE6OF01EV8QZ.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
  modified_base (535)..(535): a, c, t, g, unknown or other
  misc_feature (535)..(535): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaantccaccctntcctgcagctccagccagaatatccagagcttactacatagcctggtaccagcagaagcctggccaggcctcccaggttccctnactctatgctgggtcccagagggcccacgtggcatcccagactaggttcagtggcaggtgggtcngggacagtacttcgacttctcatcattagcagacgtggacgtccgtagaacgtatttcgactagttagtatttactgtaccgagtctaaggtattggaactttccaccttgtacgttcggttcggaccgaagggactaagggtataaagtcggaaacgtaacgtgacggtctacganacctgtcgttacg

SEQ ID NO: 145473 - DNA, 848 bp, Homo sapiens
  misc_feature: GYAE6OF01CZUEE.21.4.A04.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctcgaggggaangccacctntcctgcagctccagccagaatatccagacgctactacatacgcctggtaaccngcaagaacgcctggccaggtcctccaggttcctcgatcgtatcgcgtcgggtcccacgtcgggcctacgtcggacactcccgaagaccgtacggttacgaaggttcgggactaagggtcgggtcgtacggggtaacagggtacccttacgtacttaccgtactaacgttacgttaacgttacggtaccaaggtaaccgtacgggtaaccgtacccggttaaggtaaacggttacgttttacggaaccggttaacggtttaaccgggtttaacttttaaccggttacggtttaacccggtaacgggttaacggtaaacgggtttaacggtttacggggttaaaccggttttacccgttaacccggttttccggtttacggggttttaaccccgggttacccggggtaaaccccggtaaaaaccgggggttaaacccgggttaaaaaacgggggttaaaaccggttaaaaacggttaaccgggtaaaaaaacccgggtttaacccgggtttacggggtttaaccggggttaccggttaaccggttaaccccgggtaaaccccgttaacggtttacccggttttaaccccggg

SEQ ID NO: 145474 - DNA, 664 bp, Homo sapiens
  misc_feature: GYAE6OF01BPMUU.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccacctctcctgcagctccagccagaatctccagagctactacatagcctaggtaccagcagaacgcctggccaggcctcccgagttcctcatctatgccgtcgggtcccagacgggccacgtgggccactcccgaagtaccgtaggttcaggtcggtacgaggttcgggtccgtaggggacctacgtacttttaccgaccttcctacacttcctaacgttacgaccgtacgtacgtcgggacgtacccgttaggtaacgttacgtttaccgacgtaggttcgttaactttacgtgtacgacggtaccgtagtaacggttacgggtactttccgtaacccgttagttccggttaccggtccgggtaccggtaaacgggtaacccgtaaagggttaacgtaaagtacggtaaaccgtaacggtacggtagggtacctacggtacctaaccgtgttccgttcg

SEQ ID NO: 145475 - DNA, 549 bp, Homo sapiens
  misc_feature: GYAE6OF01D6DWD.21.4.A04.1.454.CMB.1.raw
  modified_base (216)..(216): a, c, t, g, unknown or other
  misc_feature (216)..(216): n is a, c, g, or t
  modified_base (343)..(343): a, c, t, g, unknown or other
  misc_feature (343)..(343): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (540)..(540): a, c, t, g, unknown or other
  misc_feature (540)..(540): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggaggtccctgagactctcctgtgcagcctctgctattcaccttcagtcgaccacaacatggactgggccgccaggcctccgagggagggctggagtgggccggcgtagtanaaggaagctaacagttacagtaacagaactacggcgcgtctgtaagaaggtaagtcacatctanaaganatgattacaaagacctnactgtatctagactaaatagaacagacctaagaaaccgaggacacggtccgtagtagttagttacggtaggtaagaacgaaaagtagttaggagttgggtaggtgggtaancgtgtaacg

SEQ ID NO: 145476 - DNA, 554 bp, Homo sapiens
  misc_feature: GYAE6OF01DJDNL.21.4.A04.1.454.CMB.1.raw
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaggtgtccagtgtgaggtgcagctggtggagtcgtgggggagacttgggtccagccctgggagggtcccctgagactctcctgtgcagcctntgcattcaccttcagtcgaccacaacatggactgggtcccncaggcnccgagggagggctgggagtgggtcggccgtatacaaggaaagctaaacngttacagtacagaatacggacncgtctggagaaaggaaggttcaccatctacaagagaatagattacaaagaactcacttgtatctagacaaatgaaacagacctagaaaaccgagaccgacggaccgtagtacttagttgtaggtaagaacgaaaagagtagagttaggtagggtaggtagtcgtggtacg

SEQ ID NO: 145477 - DNA, 763 bp, Homo sapiens
  misc_feature: GYAE6OF01BA0P1.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttcctgttgttattttacaagatgtccagtgtgaggtgcagctggtggagtcgtgggggatacgttggtccagcccgtgggacgggtccccttggacgtaccttccgtccgtggtcgccacggcccttctcgcctaactttcccaacctttcgaacgttcgaaccccaacaaactaacgtcgggtaaccgttcgggggtaccccgccggtaacgggtccctacccgggaaggggggaacggggtccgttagggggacgggttcgggggttaccgggtacccggttaaagttaaaccggaaaaggggtaaaacgtacgtaaaacgtacggtttaaaccgaagtaaccgaaggtaaacgtaccgggcgtacgttacgtaggtaaggaaaggtacggttacccaacgtatcgtaacgaaagagtaagtagtaacttaacaaaagtaacctactaacgttacgttaacttcgtacggaactaaaagtacggaaaccacggtaacccgtaacgaaaaccggacggaacccgacggtaccgttagttaacgtttagtcggtaaggtaacgaaacgaaaggtggtacggtagttaggtagggtcgtagtgtacgg

SEQ ID NO: 145478 - DNA, 766 bp, Homo sapiens
  misc_feature: GYAE6OF01COK8F.21.4.A04.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgtgacgcagtctccaggcaccctgtctttgctccgaaggggaaancgcccaccctctcctgcacgctccagccaagaatacnccagacnctactacatacgcctaggaccagcaagagcctggccaggcctccgtaggttccctnattctancgcgttcgggacccacgacgggccctacgtcgggacctaccgtacccgaaggtaaccgtagggtttccgaagggttcgggacgtaggggtttcggggtaccgtaggggaactacgtacctttccgaacttcacctagtactaagttaacgccgtaacggacggtagggtaaccgtacccttaagggtaaacgttacgttttacgaaccggttaaggtttactttaacgtttacgttacggtacgttaacggtaaccgttaaggttaacgtttacggggttaaacgttttaccccgtaaccggtttccgttaccggggttaccgggtttacccggaacccggggtaaaacgggtaaacccggtaaaaggggttaaacggaaaaagttaccgggaaaaaccggttaacggttaggttaccggacgttaaccggaacctaacggttaccgttacgtttaccgg

SEQ ID NO: 145479 - DNA, 702 bp, Homo sapiens
  misc_feature: GYAE6OF01EE18S.21.4.A04.1.454.CMB.1.raw
  modified_base (369)..(369): a, c, t, g, unknown or other
  misc_feature (369)..(369): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttgggtccagcctgggacgggtccctgagactctcctgtgcagcctctgcattccaccttcagtgaccacaactagtggacgtgggtcccgcgaggctccgaggggaagggctgggaggtcgggtcggcgtatacgaaggaacgctaaanagttacagtacagaatacgggcgtacgtcgtgtaaggaaagggtaaggtttccaaccctaagttccctacgaaaaggtcgtaagttaggtaactttacgaaaaacgtaaccttccaaccgttagttaactcgtacgaactaaaagttacggaaaacccacgtaaccccgttaaagggaaaaaaccccggagggtaaccccgaaccggggtacccgttagtttaaacgtttagtttaggggtaacgggttaaaaggaaacgtaaaaagggtacggttaagggggtaaactttgggggttaaggggttacggggttatccgggttggtaaaccgg

SEQ ID NO: 145480 - DNA, 764 bp, Homo sapiens
  misc_feature: GYAE6OF01AO4H3.21.4.A04.1.454.CMB.1.raw
  modified_base (216)..(216): a, c, t, g, unknown or other
  misc_feature (216)..(216): n is a, c, g, or t
  modified_base (642)..(642): a, c, t, g, unknown or other
  misc_feature (642)..(642): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagctgggttttccttgttgttattttacaaggtgtccagtgtgaggtgcagcgtggtggagtcgtggggganacgttggtccaggccgtgggacgggtccctggacgtacctctcctggtcgcagcctctgctattccaccttcagtcgaacctaacaactagtcggaccgtcgggtcccgacctaggcctaccggaaggggaacgggtctagggaggtcgggtccggaccgttaagttaacgaaaggtaaacgtccgtaaacgtacggtttaaccgaagttaacgaaggtaacgtacgggacgtcgtacgttagggtaacggtaaaacgggtacggtttacccaaccgtactaaccgttacgaaaaggtagtaagttacggtaaacgtttaaccgaaaacggtaacccttcgtaaaccgtttagttaccgtaactaacgggtaaactaaaacgttacggaaaaccgtacgtaaccccggtaaaggaaaaacccgggnggtaacccgtaccgggtaaccgttaggtaaaccttttaaggttcggtaaacgggtaaacgtaaaaggaaacgggtagttaacgggagttacgggttaggtagggtaactggttggtaaacgg

SEQ ID NO: 145481 - DNA, 705 bp, Homo sapiens
  misc_feature: GYAE6OF01CX2KJ.21.4.A04.1.454.CMB.1.raw
  modified_base (697)..(697): a, c, t, g, unknown or other
  misc_feature (697)..(697): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacgaaggtgtccagtgtgaggtgcagctggtggagtcggtgggggatcgttggtccaggccgtgggacgggtccctggagtacctctcctggtgcacggccttctgctattacctaccttacacggtacaacccaacaaacgtacggtacggaccgttcgggccccaccgaggtcctaccggaagggggaagggtccgtagggacgggttcgggcgtaccggttaagttaacgaaaggaacgtactaaacgaacggttaacaaacgtaacgaaggtaaacgtaccgggcgtacgtcgtaggtaacgggaaacggtaacggttacaaccgtacttacgtaacgaaagacgtaattaggtaacttaaacgaaagtaaaccactaaccgttagttaactacgttaacgaactaaaagtacgaaaccgaacgttaccgaaaccggaaacgaaccggtaacgacggtaccgttagtaacgttagttacggaggttaagaaacgtaaaggagtaggagtgggtaggtaggtngttgtacg

SEQ ID NO: 145482 - DNA, 580 bp, Homo sapiens
  misc_feature: GYAE6OF01CX0UE.21.4.A04.1.454.CMB.1.raw
  modified_base (404)..(404): a, c, t, g, unknown or other
  misc_feature (404)..(404): n is a, c, g, or t
tcagtcgtcgctcgcacgaccggtgctcgatttagagtagtgatcaggggagagctgctcagttaggacccagagggaaccatggaaccccagcgcagcttctcttcctcctgctactctggctcccaggctcagaaacacccccccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctcgggtcccacgacggccacgtggcactcccagacaggttcagtggcaggtggtctggacagacttcactctctatcattagcagacgtggagcctagagtntttcgctagtgtatttactgtcagtacagttagtagggtattctaccttacgtcgttaccggttcgggaacccgtaaggggtaaccctaaagggtaaacggtaaagttacgggaaaaaccgtaacgtttagggtacggtacccgtaggtaccctaaccgtacgtttcgttaaccgg

SEQ ID NO: 145483 - DNA, 629 bp, Homo sapiens
  misc_feature: GYAE6OF01DF4ZS.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcaccctgtctttgtctccaggggaanagccacctctcctgcagttccagccagaatatccagacgctactacatacgcctggtaccagccagaacgcctaggccaggcctacccaggttccctcgatcctatgcgttcgggtcccagacgggccacgtcggcactcccagacgtaggttcagtcggctaggtgggtctgggacaggtccttcacttcgtacacgtactacgttagcgtaagtacgtgggacgtcctaggaaagttcttcgacgtagttgttatttaccgttgttaccgagtacgtaagttacgttcgggtaagtttccaccttacgttcggttacggttacccgggaaccggtaacgggtaaacccgtaaagggttaacgaaaagttacgggtaaaacgtacggttacgtacggtacgtacgaccgtaaccttctgttcggttaacc

SEQ ID NO: 145484 - DNA, 538 bp, Homo sapiens
  misc_feature: GYAE6OF01BV88T.21.4.A04.1.454.CMB.1.raw
  modified_base (216)..(216): a, c, t, g, unknown or other
  misc_feature (216)..(216): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
  modified_base (455)..(455): a, c, t, g, unknown or other
  misc_feature (455)..(455): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagcctggagggtccctgagactctcctgtgcagcctctgcattccaccttcagtgaccanaacntggactgggtccncaggctcgagggagggctggagtggtcgcgtatacaggaanctaangttacagtacagaatacggngcgtctgtagaaggaagttcacatcanaagagtatgaattcgaaagtactcactgtatctgacaaatgaacagacctaggaaaccnggacacggtcgtagttactaagttgtacggttaagacaaaaggtacgtagggtaatcggttagggtaggtacgtgtggtaacg

SEQ ID NO: 145485 - DNA, 666 bp, Homo sapiens
  misc_feature: GYAE6OF01ECH3T.21.4.A04.1.454.CMB.1.raw
  modified_base (295)..(295): a, c, t, g, unknown or other
  misc_feature (295)..(295): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagcgccaccctctcctgcagctccagccagaatactccagagctacacatacgcctaggtaccagcagaagcctggccaggcctcccaggttccncatctagtcgcgtcgggtcccagcgggccacgtggacacgtcccagacgtaggttcaggtcggcgtaggtcgggtcgtaggggacacggtaccttcgacttctctaactcgtaatttacgacgtagtaccgtagggactaccgttaggtaaacgttacgtttacgacgttagttacgtttaactttacgttagtaccgtaaggtaccgtaaggttagtaagggttaaccgtttcctacccgttcgtacgggttcccgggttaccggtaaccggaaacggggtaacccggtaaagggttaaacgaaaggttaacggaaaacggtaaccggttgggtacggtacgttacgaccctaacgttacgtcgttacgg

SEQ ID NO: 145486 - DNA, 776 bp, Homo sapiens
  misc_feature: GYAE6OF01A86AH.21.4.A04.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcacctgtcttgtctccgagggaancgccacctctcctgcagctccagccagaatactccagacgactactacatacgccgtaggtaccagcaagaacgcctaggccaggcctcccgaggtttccnagtctagtcgcgtcgggtacccaggacgggcccagtcggcctactccccgaaggaccgtacggttcaggtcgggactagggttcgggtacgtacgggactacggtacctttccgaaccgttcttaccgtaattaccgtaagtttaaccggacgtaacggtaacggtacgggaacggtaccgtaaggtaacgttacgttttccggaacgttaggtttacggttaactttacgtacggttaccgtaaggtaccgtaaggttacggttacgggttaaccgtttacccgttaaccggtttaccggtttaccggggtttcccgggttaaccgggtaaaccccggggtaaaacggggtaaaccccggttaaaaggggttaaaccggtaaaacggttaaccggggtaaaaaccggttacggtttaacgggtacgggttaccgtaccgggtaacccttaacccggttacgtttcccggtttaaccgg

SEQ ID NO: 145487 - DNA, 578 bp, Homo sapiens
  misc_feature: GYAE6OF01AC15Y.21.4.A04.1.454.CMB.1.raw
  modified_base (200)..(200): a, c, t, g, unknown or other
  misc_feature (200)..(200): n is a, c, g, or t
  modified_base (569)..(569): a, c, t, g, unknown or other
  misc_feature (569)..(569): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggaccagcagaagcctggccaggcctcccgaggttccctcatctatgcgtcgggtcccagacgggcccacgtggccactcccgagacctaggttcaggtggcgaggtcgggtctgggacagtccttcacttctacatctattacgcagacgtggacgccgtagaacgtagtttcgactagtgttattctgtcagtcgtagtagtaggtacgttcctaccgttcgtcggtcgttaccggaccgtaaacgggtaaccgtaaagggtaacgaaacgtacggtaaacgtaacgttaggtacggtccgtacgacctaccgtnttcgttacg

SEQ ID NO: 145488 - DNA, 687 bp, Homo sapiens
  misc_feature: GYAE6OF01EAE4N.21.4.A04.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaaangccacctctcctgcagcctccagccaagaatactccaggnctactacatagcctggtaccagcagacgcctggccaggctcccaggtttccnactctatcgcgtcgggtcccacgacgggcccaacgtggactacgtcccaggacctggtcaggtcgcgtaggtgggtactggggactaggtcctttcaacccgttctacaacttctaagtttacggactaacggaccgttagggaccgtaccgtaggtaacgtacgttttaccggacgtaggtttacgttaacgttttaacgttcggtaccgtacggtactaacggttaagttaccggggttaacgtttccctaacccgttcggtttacggttacccgggtttacccgggaacccggtaaacggggtaaacccgtaaagggttaaacgaaacgttaacggaaaaccgtaccggttaggtaaccgggtacgtaacggacctaacctcgttacgtaccg

SEQ ID NO: 145489 - DNA, 541 bp, Homo sapiens
  misc_feature: GYAE6OF01E1A35.21.4.A04.1.454.CMB.1.raw
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
  modified_base (533)..(533): a, c, t, g, unknown or other
  misc_feature (533)..(533): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtccnccaggctccgagggagggctggagtgggtcggcgtatacgaaggaagctaacngttaacagtacagaatacgggcncgtctgtaggaaaggagttcaccatctanaagagatggattacgaaagactcactgtatctgacaaatgaacagacctagaaaaccgaggaacgaccggcgtagttatattggtaggtaanacgtaaaagngtaggagttggtaggtaggtagngtggtacg

SEQ ID NO: 145490 - DNA, 571 bp, Homo sapiens
  misc_feature: GYAE6OF01A95B6.21.4.A04.1.454.CMB.1.raw
  modified_base (201)..(201): a, c, t, g, unknown or other
  misc_feature (201)..(201): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaagngcccaccctctcctgcagctccagccagaatatccagagctactacatacgcctggtaccagcagaacgcctggccaggcctcccgaggttccctcatctagtcgcgtcgggtccccagacgggcccacgtggctactcccagacgaggttcaggtggcaggtcgggtctggggacagtcttcactctactatcgtaattacgcgagtacgtggacgcctagaacgtnttcgntagtnttacttacgtcgtanagctaagtagtggtaacgttccaccgttcgtcggtccgttacggacccgtaaagggacctaaagggtagtaaagtacggaaacgacgtggtacgacgttacgaccactgttcgtacg

SEQ ID NO: 145491 - DNA, 703 bp, Homo sapiens
  misc_feature: GYAE6OF01CYXCJ.21.4.A04.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcacctgtctttgtctcgagggaaancgccaccctctcctgcacgcctccagccaagaatacnccagagtcctaactacatagcctggaccagcagaacgcctggccaggcctcccgtacgttcctcattctatcggccgtccgggtccccaagcgggccacgtcggacacgtcccagtaccgtaggttaccgaggttggcacggggttgggttccaggggtaaccaggtacctttaccgtacctccgtactaactacgttaacgttacggacctaacggtacgtacgggtaccgtacccgttaaggtaacgttaacgtttccggaaccgttaggtttacgttaacgtttacgtcgtaccgaagtacgtaaggttacgttacgggtaactttccgtaaccgtttcgtcggttaccggttaccgggaaccgtaaacggggtaaaccgtaaagggttaaacgtaaaggtaacgggtaaaaccgtacggttaggtaccggtacggtacgaccgttaaccgtcgtttcggttaccg

SEQ ID NO: 145492 - DNA, 780 bp, Homo sapiens
  misc_feature: GYAE6OF01CYPXO.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggcaccctgtctttgctccgaggggaanacgccaccctctcctgcagcctccagccaagaatactccagagtctactacatacgcctggtaaccagcaagagccgtaggccaggtcctcccgtaggttccctcaacgttctacgttcggaccgttcggggtaccccaaggacggggacccctaacggttcgggaccctaacgtccccgaaggtaaccgttaagggtttccgaagggtttcggggaccttaaggggttcggggttacctacgggggtaacaccgggtttaaaccttttccgaaaccttttccgtacctaagtttaccgtaaacgtttacggacccgtaagggtaaccgttcggggaacgttacccggtaaaggtaacggtttaacgttttccggaaccgttaagggtttacgttaacgttttacgtcggttacgagtaactaacgttagtaggtaacgttcctaccgtttcgtacggttaccggttaccgggaaccgtaaacggggtaccgtaaaagggttaacgtaaaaggttaacggtaaaacccggttacgttagggtacgtaccgttacggaccgttaacctacgtttccgttacgg

SEQ ID NO: 145493 - DNA, 647 bp, Homo sapiens
  misc_feature: GYAE6OF01C8S7Q.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctccaggctcagaaaccacggagaaattgtgttgacgcagtctccaggcacctgtctttgctccgaggggaaancgccacctctcctgcagctccagccagaactactccagacgctactacgatacgccgtcgtaccacgcagaacgccgtcggccgacggcctcccgacggttcctcgactctacgtcgcgtcgggtccgacgacggccgacgtcggcactccacgacgacggttcgacgtcggcgaggtacgggtcgtcggacgcgtaaaaaacgttctacgtctacgactactagttacgacgtagtacgtggacgtcgtagaacgtacgtttacgtacgtacgttagttacgtttacgttacgtacgtacgtacgtagttagttacggttaacgttacgtaccgttcgttcggttacggttaccggtaccgtaaacgggtaaccgtaaacgggtaaacgtaaagtaacggtaaacgtaacggtaggtacggtacgtacgaccgtacctacgttcgttacg

SEQ ID NO: 145494 - DNA, 854 bp, Homo sapiens
  misc_feature: GYAE6OF01DCEDI.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaagggaangccaccctntcctgcagctccgacgccaagaactactccaagacgactactaacataacgcccgtaggtaaccaggaccaagaaacggcccttcggaccgaacgggtccttaccccgtaacggggtttcccctacgaacttcttaagtcgtccgtaccggggtcccaaccgacggggtcccaaccgttcgggacctacgtacccccgaaggtaccgtaacgggtttccgtaaacgggttcgggacggtaaacggggttcggggtaccggtttaaggggaaccgtaacgttaacccggtttaccaccggtttacccgtttaaccaacgtttacgtaaacgttttaacggaaccgtacgggtaacgttacgggtaaccggtaccgttaaagggtaaaccgttaacgtttaccggtaccgttaaggttacgtttaacgtttaacgtttacggtaccgtaaggtacctaaggtttaacggtaacgggttaaacgtttaccgtaacccgtttacgttccggttacggtttaacccggaccggttaaaaccgggaacccggtaaaaggttaaacggaaaagtttaacggaaaaacccggttaaccggtaggttaaccgggtaccttaacggggacccaacccggttaagtccgtttaacccg

SEQ ID NO: 145495 - DNA, 833 bp, Homo sapiens
  misc_feature: GYAE6OF01C06Q6.21.4.A04.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangcccaccctctcctgcacgctccagccaagaatanccagacgctaactacatacgccttggtaaccagacaaggaacgcctagggacccaggcctccccgaggtttccctacgacttctagtcggccgttccggggtaccccaacggacggggccctaacggtcggcctaacgtccccaaggtaccgtaagggtttccgaagggttcgggcgtaacggggttggggttacctagggggaaccagggttacctttccgaacctttccgtacgtacttacgtaacgttacggaccgtaacggtaccgttacgggaaccgtaccgttaagggtaaccggttacgtttttaccgacgttaaggtttaacggttttaactttaaccgttacggttaaccgtaagggttaaccgttaaaggtttaacggtttaacggggttaaccgttttacccgtacccgttttacggtttaccgggtttacccgggtttaacccggggaaacccggttaaaacgggggtaaccccgtaaaaagggggttaaacgtaaaacggttaacgggtaaaaacccggttacggtttaacggttacgggtaacccgttaccggtacctaaacccggtagtttcccgtttaccgg

SEQ ID NO: 145496 - DNA, 635 bp, Homo sapiens
  misc_feature: GYAE6OF01ERTZL.21.4.A04.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaagttgtgttgacgcagtctccaggcaccctgtctttgctcgaggggaangcccacctctcctgcagctccagccaagaatanccagagctactacatagcctggtaccagcagagcctggccaggcctacccaggttcccnattctagtcgcgtcggacccagacgggcctagtcgacactcccgagacgtaggttcaggtggcagggttcgggtactacggggaacctagggtacctttcgaaccgtttctaacgacttaccgaagtttacgacgtaacggacgttcgggactaccgttaggaacgttcgtttacgacgtagttagttactttacgtagtccaggtactaaggtactagggttaactaccgtaccgttctacggttccgtaccggacgtaaaccgggtacctaaagggttaacaaaggttaccggaaacggttacgtaggtacggtacctaggaacccacgttgtaccgtttcg

SEQ ID NO: 145497 - DNA, 693 bp, Homo sapiens
  misc_feature: GYAE6OF01EJNE0.21.4.A04.1.454.CMB.1.raw
  modified_base (242)..(242): a, c, t, g, unknown or other
  misc_feature (242)..(242): n is a, c, g, or t
  modified_base (360)..(360): a, c, t, g, unknown or other
  misc_feature (360)..(360): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctgggagggtcccngacgactctcctgtgcagcctctcgctacttctaccttcacgtggaccaaccaaacaactggacgtacggtccggccacggacgtccgacgggaaggggacgtgggtaggtacggggntagggtaccgtaaggttaaacacggtaaaacgacggttaaaccaaggtttaaccctaaggtaaacttaacgggaaacgtaaaccgggtaccggtaccggttcgtaaacgggtaggtttaacggaaaccgggttaagtacccgtaacgtaacgtacgaaaagtacggaagtttaacgaaagttaactaaacgaaacctaccgtaactcgttagtactaagtcgaaaactaggaacctaagaaacccgtacggtaaaccgaacggaaccgtacggacgttacgtagttagttgtaggtaaggacgaaggaagtgagtagtaggtgtaggtgtacg

SEQ ID NO: 145498 - DNA, 632 bp, Homo sapiens
  misc_feature: GYAE6OF01DBJ5O.21.4.A04.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcaccctgtctttgtctccgaggggaaangccacctctcctgcagcctccagccagaatactccaganctaactacatacgcctggtaccagcaagaagcctggccaggcctcccgaggttccctacattcctatcggcgttcgggtacccaacgcgggacccacgtggcactcccagactggttcagtgcaggtggcnggacngacttcactcnatcagtgcagtaccgtggacgtacgttaggaacgttgtttaccgacgttaagttcgttaacttttaccgtggttaacacggtaactaaggttaagttacggggtaaactttcctacccgttagttcgggttaacccggttaccgggaacccggaaaacggggtaccgtaaaagggttaaactaaaaggtcggaaaaacggtaaccgtggtaccgggtactacgaccaaaccgtgtttcccgttaag

SEQ ID NO: 145499 - DNA, 573 bp, Homo sapiens
  misc_feature: GYAE6OF01BFPTG.21.4.A04.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanatccaccctctcctgcagctccagccagaactatccagagctactacatagcctggtaccagcagaagcctggccaggcctcccgaggttccncatctatcgctcgggtcccacgagggcccacgtcggactacgtcccgaagacctaggttcaggtggcgaggtcggtcgtgggacagtacttcactctacatcattagcagacgtggactcgtagtaacgtcttcgacgtagtgttaacttacgtagtcgacgtcgtaagttagtacggtaacttcctacttcgtcgttcggtaccggaccgaacgggtaacgaagggtaaagtaaagtacggaaaacgtacgtggtacggtctacgacacttgtcgtcg

SEQ ID NO: 145500 - DNA, 534 bp, Homo sapiens
  misc_feature: GYAE6OF01EJ1VS.21.4.A04.1.454.CMB.1.raw
  modified_base (407)..(407): a, c, t, g, unknown or other
  misc_feature (407)..(407): n is a, c, g, or t
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
  modified_base (506)..(506): a, c, t, g, unknown or other
  misc_feature (506)..(506): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactggggtccgccgaggctccgaggggagggctgggagtgggtcggccgtatacgaaggaagctaacagttacagtacagaatacggcgcgtctgtagaaaggagttcaccatcanaagagatgaattacaaagactcacttgtactctgacaaatgaacngtacctagaaaccgngacacggcctagttatagttgtaggtaagaacgaaaggngtaggatggtggtaggtagcgtggtacg

SEQ ID NO: 145501 - DNA, 895 bp, Homo sapiens
  misc_feature: GYAE6OF01E5L27.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctccaggctcaagaaccacggataaattgtgttgacgctagtctcacggcctacctgttcttgtccgtaccgaaggggaacacgccctacctctccgtgacacgcctaccgacgaccaagaactactaccgagacgtctaactactagtacgccgtacggtaaccacgtcaacggaacgtccgtacggaccgtacgggtcccctaccccggtaacggtttccctaccgtacgttaccgttaacgtccgggttaccgttacccggggtacccaaccgggtaaccgggtccctacgggtaccggaacctaaccgttaccccgaaggtaaccgttacgggttaccggtaacgggtcggggtaacggtacgggtttcgggtaccgggtaaacgggtacccgttacggttacccttacgtaccgttaccgtaacgtacgttaacgtacggttaacggaccgtaaggtacgggtacggtaaacgtccgttaagggtaaccgttacgtttaccggtacgttaacggttaccgtttaacggttaccggttacggtaacgtaacgggttaccgtttaaacggggttacggtttaaccggtaaccgttttacccgtacggtttaccgggtaccgggtttaacccggtaaccgggtaaaccgggtaaaccgggtaaaccggttaaacggggtaaaccgttaaagggtaaacccggtaaaacggttccgggtaggttaccgtacgtaccggttaacccttaccggttaacgtttcccggttacg

SEQ ID NO: 145502 - DNA, 595 bp, Homo sapiens
  misc_feature: GYAE6OF01AJGB9.21.4.A04.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangcccaccctctcctgcagcctccgagccagaactatccagacgctaacgtacatacgcctaggtaccagcagaacgcctggaccaggcctccgaggttccctanatctagtcgcgtcggtcccagacgggccacgtcggacctacgtcccgaagcgtacggttcaggtcggcgtaggtcgggtctagggaccagtacctcactctactactcgtatacgcgacgtacgtggacgtcgtagaacgtctttacggactagttagtacttacgtgacgacgtacgtaaggtgtacggtaacttccctacgttcgtcgttaccggtcgaccgtaacgggtacctagggtaactaggtaagaaccggtagtgtcggtacctacgaccgtctcgttgtacg

SEQ ID NO: 145503 - DNA, 586 bp, Homo sapiens
  misc_feature: GYAE6OF01BWEAU.21.4.A04.1.454.CMB.1.raw
  modified_base (239)..(239): a, c, t, g, unknown or other
  misc_feature (239)..(239): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccaganctactacatagcctggtaccagcagagcctggccaggctcccagttccnatcatgctgggtcccagacgggccactggactactcccagaccgaggttcgaggtcggcgtaggtggggtcgtgggaacgagacgttacacgtcctctatctattacgcgagacgtggacgtacgtagtaagtacgtttcgtacgtagttagtattactacgtgacgtgtaagtagttagggtaacgttactaccctcgtcgtacggttccggaccggtaaagggaccgtaacgggtaaacgtaaagacggtaaaacgacttagggtcggtaccgtagaccgtacctacgttcgtccg

SEQ ID NO: 145504 - DNA, 798 bp, Homo sapiens
  misc_feature: GYAE6OF01BWN3T.21.4.A04.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccacctctcctgcagctccagccaagaatnccagagctactacatacgcctaggtaccagcaagaacgccgtggccaggcctcccgaggttcccactactctatcggcgtcgggtacccaacgacgggcccacgtcgggaccacgtaccccgaggtaaccgtaggtttccgaagggttcgggaccgtaaggggtttcggggtacgtaggggaacctaacgggtacccttttacaaccgtttcctactaactaccgtaacgtttaacggaccgtaacggtaaccgtgggtaaccggtacccgttaagggtaaacgtacgttttaccggacggttaacggtttacggtttaactttacgtttcggtaccgtaacggtaccgtaaaggtttacggttaacggggttaaaccgttttacccgtaacccgtttacggttaccgggttaccgggtttaccgggaacccggttaaaacgggggtaaccggtaaaaggggttaaacggtaaaacgggttaacggtaaaaaccgggttaacgttaacggggtacgggtaaccgttacgggaacccgttaacccgttacgtttaccggtttaacccg

SEQ ID NO: 145505 - DNA, 845 bp, Homo sapiens
  misc_feature: GYAE6OF01DSJ09.21.4.A04.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaacgaaaccaccggaagaaattgtgttgacgcagtctccaggccaccctgttctttgtcctaccgaaggggaaancgcccaccctctcctgccagcctccagaccaagaactactaccgaagacgtacctaactacgaactacgcccgttacggtaacccaaggacaacggaaaccgtcccggtacgggacccgtacggtccccttacccccgtacggttttacccctaccgtaacgttaccgttaacgtccggtcccggttacccgggggtaacccccaacggacccggggtaccctaccggttacgggacccctaaccgtaccccgaaggtaacccgtacggttaccggtaaggtccgggtaccgttaggggttcgggttaccggtacggggtaacctaccgggtttaccttacccgtaccttaccgttacctaacgttacgtaacgtttaacggaccgtaacggtaccggtacgggtaaccgtccggttaagtaaacgttacgtttaccggacttaagggttacgttaacgttttacgacgtacgtaggtacgtaaggttagttacgggtaacttccgtacgttcgttacgggttaccgttccgggaaccgtaaacgggtaaaccgtaaagggtaaacgtaaagtaaacggtaaaccgttaacgggtacgtacggtacgtacgacccgaaccgtttgtccgttaccg

SEQ ID NO: 145506 - DNA, 630 bp, Homo sapiens
  misc_feature: GYAE6OF01AX430.21.4.A04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaancgccacctctcctgcagctccagccaagaatactccagagctactacatacgcctggtaccagcagaagcctggccaggcctccgaggttcccnatctatcgcgtcgggtacccacgacgggccacgtcggactaccgtccccgagaccgtaggttcgaacggtcgggacgagggttcggggtacgtacggggaactaggtaacctttccgaacctctacaactctagttacgactagtacgtggacgtccgtagaagtctttcgacgtagttagttatttacgtgtacgtagtactaaggttagtagggtaacgttccacgttcgtcgttccggttccggaaccgaacgggtaaccgtaaagggtaacgtaaagttacggaaaacgttacgtacggtacggtacgtacgacctaccgtagttccgtacg

SEQ ID NO: 145507 - DNA, 601 bp, Homo sapiens
  misc_feature: GYAE6OF01CN6KY.21.4.A04.1.454.CMB.1.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgttagtatttacaagtgtcagtgtgaggtgcagctggtggagtcgtgggggatactttggtccagccgtgggacgggtcccctggagtacctctcctgtcgnagccctntgcattcaccttcagtcaccanacgatggactggtccncgagcgtaccgagggagggctgggagtggtcggacgtataacgaaggaagactaacgagttacagtacagaaatcggacgcgttgtagagaacgggtagttaccacaatctagaaacgtagaatacgaattaacaaaagtacgtcaacttgtaatcgtagacaaatagaactaacgtctaaacggaaaccgacggacgtaccggaccgttaaggttacttaagtagggttacggtaaacgtaaagaaaacggtgttaaggtacgtagggttacggttagggtagtcggtgtaacgg

SEQ ID NO: 145508 - DNA, 712 bp, Homo sapiens
  misc_feature: GYAE6OF01DPNK6.21.4.A04.1.454.CMB.1.raw
  modified_base (199)..(199): a, c, t, g, unknown or other
  misc_feature (199)..(199): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaaancgccaccctctcctgcagctccagccagaatactccagacgctaactacatacgcctaggtaccagcaagaacgcctggccaggcctacccgaggtttcccngatctatcgccgtcgggtacccaacgcgggcccacgtcggacctacgtccccgaaggaccgtaggtttccaaggttcgggacgttaagggtcggggtactagggggtaaccacgggttaccttttaccaaccgtttccttactaacgttaccgttaacgtttaacggaccgtaaggtaacccggttagggtaaccgtaccgttaaggtaaacgttacgtttaccggacgttagtttacgtttaacttacgttggtacgagtcgtaagttacgttaggtaacgtttccaccgtttcgttacggttccggttaccgggacgtaaacggggtaaccgtaaagggtaactaaaggtaacggtaaaaccggtacgttacggtacggtactacgtaccaaccttacgttccgttacg

SEQ ID NO: 145509 - DNA, 736 bp, Homo sapiens
  misc_feature: GYAE6OF01EZ67N.21.4.A04.1.454.CMB.1.raw
  modified_base (200)..(200): a, c, t, g, unknown or other
  misc_feature (200)..(200): n is a, c, g, or t
  modified_base (302)..(302): a, c, t, g, unknown or other
  misc_feature (302)..(302): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggccaccctgtctttgtctccgaggggaancgccaccctctcctgcagcctccagccagaatactccagagctaactacatacgccgtaggtaccagcagaacgccgtggccaggcctcccgaggtttcccnctatctagtcgccgttcgggtcccacggacgggccctacggtcggacctaccgtcccgaagaccggtacggtttccgaaggtcgggactaggggttcggggtaccgtacggggaacctacggttacctttcgaacccgttctacgtaacgtttaccaagtttacggacgaacggtaccgttagggtaaccgtaccggttaaggtaaacgttacgttttaccggacgttaaggtttacgttaactttacgtcgttaccgaacggttacgtaaggttacgtaacgggttaacttaccttaccgttaccgttacggttacccggttaccgggaacccggtaaaccggggtaaccgttaaaggggtaaacgtaaaggttaacggaaaccggttacgttggaccggtacctacgaaccgtacccgttagttcgttaccg

SEQ ID NO: 145510 - DNA, 643 bp, Homo sapiens
  misc_feature: GYAE6OF01A2M0I.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (294)..(294): a, c, t, g, unknown or other
  misc_feature (294)..(294): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctcagccagatatccagngctactacatagcctaggtaccagcaagaacgccgtggccaggtcctccgtaggttccncatctatcgcgtcggtcccacgcgggccagtcggcactcccagcgtacggttcagtggcaggtcgggtcngggacncgtacttcactctctagtcaagttcgactacgacgtggacgccgtagtaacgtacgtttcggacgtaggtttacgttaacgtttacgttcgtacacgtaacgttaacggttagttacggggttaaactttcccgtaaccgttcgtttaccgggtaccggtttccgggaacccgtaaaccggggtaacgtaaaacgggttaacgaaaacggttaacggaaaacggttaacgttgggtacgaccggttacgaccgtaacctacgttcgtttacgg

SEQ ID NO: 145511 - DNA, 762 bp, Homo sapiens
  misc_feature: GYAE6OF01CNIMJ.21.4.A04.1.454.CMB.1.raw
  modified_base (245)..(245): a, c, t, g, unknown or other
  misc_feature (245)..(245): n is a, c, g, or t
  modified_base (316)..(316): a, c, t, g, unknown or other
  misc_feature (316)..(316): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcttgttgttattttacaaggtgtccagtgtgaggtgcagctggtggagtcgtggggggatacgttggtccaggcctgggacgggtcccnggacgtacctctcctgtgcagcctctgctattccaccttcagtcgaccacaacatcgggactcgggtcccnccgagggccctaccggaggggaacggggcgtagggagggtgggtccgggaccgttaagttaaccgaaaggaaacactaaacgtaagttaacaaggtaaccaaggtaaacgtaccgggtcgacggttcgtagggtaaggaaaacggggtaacggtttaccaacccgtacgttacgtaaacgaaagggtaacgtaagttaacgtaatttaaccgaaaaagtaaacccgttacgtaaccgtttaaggttaaccgttacgttaacgaaacctaaaagttaacggaaaaccgtaacggtaacccgtaaaacgggaaaacccgaggtaacccggtaaccgggtaccgttaggtttaaccgtttagttaagggtacgggttaaaggaaaacgtaaaagggtaggttaacggtaaggttcgggttaaggggttaggtacgtggttacggtaacg

SEQ ID NO: 145512 - DNA, 780 bp, Homo sapiens
  misc_feature: GYAE6OF01DFWPL.21.4.A04.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggagtttgggctgagcttggttttccttgttgttattttacaggtntcagtgtgaggtgcagcgtggtggagtcggtgggggatacgttggtccacggtcccgtagggacgggtccctaggacgtaccttccgtccgtggtcgcgacgtcccttcgtcgctacttcctaacccttcgaggtacaacccctaacaaccgtagtcgggaaccttcggggtcccgaccgacggtccgtacccggaaggggaacgggtccgtaggggtacgggttcgggtaccgggtaccgttaacgtaaccgaaaagggaaacgtacgttaaacgtacgttaacgaagtacgaagtaacgtaccggcgtcgtacgtaggtaacggtaaaggtaaccggttaccaaccgtacgttacctaacgaaaaggtagtaagttaacgtaaacgtttaaccgaaaacggtaacctacgtaacgttagttaacgttacgtacgaaactaaagtacgaaaccgtaccgtaacccgtaaaacggaaaaccggaacggtaccgaccgggttaacgttacgtaaacgtttagttacggggtaacgtaaagaaacggtaaaaggtcgggtagtaaggttcgggttaagggtaggttacgcgttaggtaaccgg

SEQ ID NO: 145513 - DNA, 809 bp, Homo sapiens
  misc_feature: GYAE6OF01CIO0W.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaggtgtccagtgtgaggtgcagcgtggtggagtcggtgggggagtaccgttggtcccaggtccgtgggacgggtcccctggagtacctcctccgtggtcgcacgtccctctcgactacttcctaccttcagtacgaaccacaacagtcggacgttcgggtcccgccgaggccgtaccgggaagggggaacggggtcgtaggggtacgggtcggggtccggtacccggttaaagtttaaccggaaaacgggtaaacgtaccttaaaacgtaacggtttaacgaaggttaaaccgaaaggtaaacgtaccgggaccggtcggttaccgttagggtaaggtaaaacggggtaacggttacctaacccgtaacgtaccgtaaccgaaaggaacgtaatacggtaaactttaacgaaaaacgttacctaccgtaacgttagttaacgtacgtaacgaactaaagtacgaaaccgtaacggtaccgtaaaccggaaaacccgacgggtaaccgaacccgggtccggttaagttaaccgtttaagttagggttaacgggttaaacggtaaaacgtaaaaggggttacggtaaggttaaggttacgggttaggggttaaggggtacgtggtttacgggtaacgg

SEQ ID NO: 145514 - DNA, 583 bp, Homo sapiens
  misc_feature: GYAE6OF01E0ULP.21.4.A04.1.454.CMB.1.raw
  modified_base (199)..(199): a, c, t, g, unknown or other
  misc_feature (199)..(199): n is a, c, g, or t
  modified_base (264)..(264): a, c, t, g, unknown or other
  misc_feature (264)..(264): n is a, c, g, or t
  modified_base (503)..(503): a, c, t, g, unknown or other
  misc_feature (503)..(503): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaaancgccaccctctcctgcacgctccagccaagaatactccagacgctactacatacgcctggtaccngcagaacgcctggccaggcctccccgaggttccctcattcctatcggcctcggggtaccccagacgggcccaacgtggactactcccagaccaggttcaggtcggcaggttcgggtctaggggactacgtacctttcgacttcctactactcaattacgcgtagtacgtggacgtcctagaacgtatttcgacgtagtcgtattcgtgtacagacgtaagtagtagtacgttcaccttntcgtcgtcggaccgaacggaccgtaaaggtacgaaagtacggaaacgtacgtgtacgtctacgaccacctattcgttacg

SEQ ID NO: 145515 - DNA, 748 bp, Homo sapiens
  misc_feature: GYAE6OF01CQM6O.21.4.A04.1.454.CMB.1.raw
  modified_base (194)..(194): a, c, t, g, unknown or other
  misc_feature (194)..(194): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaccacggagaaattgtgttgacgcagtctcaggcaccctgtcttgctccgaggggaangccaccctctcctgcacgcctccagcccaagaactactccagacgtctacactatacgcctacggtaccagacagaacgccgtggacccagggcctcccgtaggttccctacaactctagtcgcgtcgggtcccagacgggccacgtcggcctactccccgaagtaccgtacggttcaaggttcgggacgtaacggggttcggggtccgtaggggaaccctaggttaaacccgttcgaacctttcccgtactacgttaactacgtttacgaccgaacggtaacgtcgggacgtaccgttaaggaaacgtttaacgtttccggaagttaacggttacgtttaacgtttaccgtaggtaccgtaaggtcgttaaggttaacggttacgggtaacgttttaccccgtacgtttacggtttccggtaccgtttacccgggaaccggtaaaaccggggtaccggtaaaaggttaaacggaaacggttaaacggtaaaaccggtaacgttacgggacggttaaccgtacggtaccctaaaccgttcgttcgtttaaccgg

SEQ ID NO: 145516 - DNA, 897 bp, Homo sapiens
  misc_feature: GYAE6OF01D9948.21.4.A04.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagagtagtgatcaggggagagctgctcagttaggacccagagggaaccatggaaaccccagcgcagtcttctcttcctcctgctactctggctcccaggctcaacgaaccacggagtaaattgtgttgacgcagtctccgaggcctacccttgttctttgtcctaccgaaggggaaacgcgccctaccctctccgngccagcctccgagccaagaactctaccagacgtacctaactacaagtacgtccgtacggtaaccaggaccaaggaacgtcccgtacgggaccgtacgggtacccttaccccggtaacggtttccctacgtaacgtttccgttaacggttccggtacccggtttacccggggtaccccaacggggtaacccggtacccgtaacggtccgggaacccctaaaccgtaccccggtaaacgggtaaccggttacgggttaccgtaacgggtcggtacccggttaaggggtttccgggtaccggttacgggtaaaccgtacgttacccgtttaccgtaaccgttccgttaccgtaaacgttaccgtaaccgtttacgaccggtaacgggtacgttaacgggtaccggtaaccgtaaggtaaacgtttaccgtttccggaacggtttacggttttaacgtaaccgttttaccggacggtaaccgacggttaacgtagggtttaacgtacccgggttaaacttttcccggtaccggtttcgtttacccgggacccggttaacgggtaaccgggtaaaaccgggtaacgttaaagggtaaacgtaaaggttacccggaaacggttacggtacggttaccgacgttaacgaacccgttagtccgtttcggttaaccg

SEQ ID NO: 145517 - DNA, 645 bp, Homo sapiens
  misc_feature: GYAE6OF01ASG8O.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaattgtgttgacgcagtctccaggcacctgtctttgtctcgaggggaanacgccacctctcctgcagctccagccagaatctccgagagctactacatagccgtaggtaccagacaagacgccgtggccacggcctccccgtaggttccctacatctagtcgtcgtcgggtcccacgacgggcctacgtcggcactcccgaagtacgtacggttcgacggttggccgtagggtcgggtcgtaggggactacggtaccttcgaccttctacgtatctaagttacgacgtagtcgtacggacgacgttaaggaagttcgtttacgacgttaggttacgttactttacgtcgtacgtacgtcgttaggtagttacggttaacgttcctacgttcggttcggttaccggttaccggaccgggtaaggaaacccgttaaagggtaacgtaaacggtacggaaaccgtacgtaggtcgtacgtacacgtactacgttgtaccg

SEQ ID NO: 145518 - DNA, 648 bp, Homo sapiens
  misc_feature: GYAE6OF01B7GEV.21.4.A04.1.454.CMB.1.raw
  modified_base (201)..(201): a, c, t, g, unknown or other
  misc_feature (201)..(201): n is a, c, g, or t
  modified_base (472)..(472): a, c, t, g, unknown or other
  misc_feature (472)..(472): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaagngccaccctctcctgcagcctccagccagaatactccagacgctactacatacgcctggtaccagcagaacgcctcggccacggcctccccgtaggttccctcacttctagtcggccgtcgggtccccacggacgggcccacgtcggacctactccccgagaccgtacggttacaggtcggctagggtgggtcgtgggacagtaccttcacttctcactcattacgacagtacgtggacgtaccgtagtaacgtactttcgacgttaggttntttaacgtttacgtcgtacgtaggtacgtaaggttagtacgggttaacgttccttaccgttcgttacggttccggttaccggaccggtaaacgggtaaccgtaaagggttaaagtaaagtaacggtaaaacggtacgttcggtacggtacgtacgacctaccgtattccggttacg

SEQ ID NO: 145519 - DNA, 647 bp, Homo sapiens
  misc_feature: GYAE6OF01BJKO4.21.4.A04.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggaggagctgctcagttaggacccagagggaaccatggaaaccccagcgcagcttctcttcctcctgctactctggctcccaggctcagaaccaccggagaaattgtgttgacgcagtctccaggcaccctgtcttgctcgagggaancgccacccgtntccgtgcagctaccagcagaatntccagacnctactacatacgcctggtaccagcagaacgcctggccaggcctcccgaggtttccncatctatcgcgtcgggtcccagacgggccacgtggaccactcccgagacgtaggttccaggtggacgtaggtgggtacgtgggaacacgtacgttcacgttcctacaagttacctaattacggactacggtacgtagggtacgaccggttaggaacgttacgttcgaacgtagtttacgttacgttaacgttcggtactagtacgtaaggttaggtagggtaaacggtttcctaaccgttcgttccggttaccggttaccgggaccgaaacgggttaaccggtaaagggtaacgtaaaggacggtaaacgacgttgggtacgtacgtacgtaccgaccgtagttccgttacgg

SEQ ID NO: 145520 - DNA, 669 bp, Homo sapiens
  misc_feature: GYAE6OF01A0SHX.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgcttctctggctcccagacaccactggagtgattgtgatgacgcagtctccagccaccctgtctgtgtctccagggggggacccgcccaccctctcctgcacacgccagtcagtctatcgctgacgttgggttacgccgtcggtaccagacaagaatcgtcggccaggcctaccgagtcctcctactacgtttaccgtgcactcccgaaccgacgggtccctacggttcggtccgtaccccgaagtaccgtacgggttacgaggtcggggtacgggttaggtacgtttcggggaactaggttacgtttttcctacctaccgaacctagtccgacgtcccgtaccctaacgaggtagtacgaagtagttggtgtacgttagtttattcgtagaccagtactaattaacttaacgttcgtacggtccgtcggtaccggttaccggtacggttccggaccggtaaccgggacgtaacgggtaacggaaacgtaccgtaaaccggtacgtcggtacggacgtacgacctaacctacgttaccgttcgttccttcgtaccg

SEQ ID NO: 145521 - DNA, 632 bp, Homo sapiens
  misc_feature: GYAE6OF01CIT4L.21.4.A04.1.454.CMB.1.raw
  modified_base (201)..(201): a, c, t, g, unknown or other
  misc_feature (201)..(201): n is a, c, g, or t
  modified_base (623)..(623): a, c, t, g, unknown or other
  misc_feature (623)..(623): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagcctccagccaagaactatccagacgctaactacatagcctggtaccagcaagaagccgtggccaggcctcccgaggttccctcacttctactcggccgttcgggtaccctacgacgggcctacgtcggcacgtcccgagaccgtaggttcaggtcggacgaggtcggggtcgtggggacctaggtacttcacttcgtactactctaagttacgctagtacgtggacgtacctaggtaacgtacgtttcgacgtagttcgttaactttacgtaggttacagtcgtaagttacgtagggtaacttcctactgttcgttacgttccgggaacgaacgggtaaccgtaaagggtaacgtaaagtaacggtaaacggaacgttagtacgggtctacggactaacccgtnttccgttcg

SEQ ID NO: 145522 - DNA, 616 bp, Homo sapiens
  misc_feature: GYAE6OF01EQ0IU.21.4.A04.1.454.CMB.1.raw
  modified_base (219)..(219): a, c, t, g, unknown or other
  misc_feature (219)..(219): n is a, c, g, or t
  modified_base (528)..(528): a, c, t, g, unknown or other
  misc_feature (528)..(528): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggganacgttggtccagcctgggagggtcccctgacgactctcctgtgcagcctctgcattcaccttcagtcgaccacaacagtcggacgtcgggtcccgccaggcctccgaggggaaggggctgggaggtggggtcgccgtaattacgaaaggaaagctaaacagttaacagtaacagaacgtacgggcgtcgtcgtagtaggtaaaacgggtaggtttaccaacctaatcctaacaaagagtaataggaacttacaaaacgtaactcgaactgtaatctagactaaatgaacagaccctaagaaaacccggnggaacacgggacgttagtaattagtaggtaggtaagaaacgaaaaggtaggtaggtaagttcgggtaggttagggagtgttaggtacg

SEQ ID NO: 145523 - DNA, 730 bp, Homo sapiens
  misc_feature: GYAE6OF01AX3QD.21.4.A04.1.454.CMB.1.raw
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaagcgcccacctctcctgcagctcagccagaatatccagagtctactacatacgcctggtaccagcagaagcctggccaggcctacccgaggttcccnacttctatcgcgtcgggtacccacgacgggcccacgttcgggacctacgtaccccgaggtaccgtagggttccgaaggttcgggccgtaagggttcggggtcgttaggggaactacgttaccttccgacgttctacgtacttactaacgtttacggacctaagggtaccgtagggtaaccgtcccgttaaggtaaacggttcgttttaccgggacgttaaggtttacgtttaacgtttacgttaacggtaccgtaggtaccgttaaggttaacgttaacggggtaacgttttaccgacccgtttggttccgggtaccgttacgggtaacccgttaaacgggtaaccgtaaagggtaacggttaaagtacggtaaaaccggtaccggttaggtaccgggtacgtaccggtaccgtaccttaagttccggtttaacg

SEQ ID NO: 145524 - DNA, 555 bp, Homo sapiens
  misc_feature: GYAE6OF01EYQCW.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctnatctatcgctcgggtcccagacgggccacgtggccactcccaagaccgaggttcaggtgggcaggtcgggtctggggactaggtaccttcgactctacatcattagctagtacgtggacgcctagaagtactttcgactagttgttattacgtgtcagctagtagtaggtaacttcactgtcgtcgtcggaccgtaaaggaccgtaagggtaacgtaaagtacggaaaacgtacgtggtacgtacgtcgacacctagtcgttacg

SEQ ID NO: 145525 - DNA, 640 bp, Homo sapiens
  misc_feature: GYAE6OF01CQ3HR.21.4.A04.1.454.CMB.1.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (417)..(417): a, c, t, g, unknown or other
  misc_feature (417)..(417): n is a, c, g, or t
  modified_base (445)..(445): a, c, t, g, unknown or other
  misc_feature (445)..(445): n is a, c, g, or t
  modified_base (596)..(596): a, c, t, g, unknown or other
  misc_feature (596)..(596): n is a, c, g, or t
  modified_base (628)..(628): a, c, t, g, unknown or other
  misc_feature (628)..(628): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctggagcgtggtttcgtgtaggtacttacaagtgtcagtgtgagtgcagctgggngagtcgtggggagtacttggtccaggtcctgggcgggtccctagacgctcctcctggtcgcagtccctgtgactacttcctaccgtttcgcggttacaacccagaacngttcgggaccgttcgggcccgcgacggtccaccggagggggagggtcgtaggcggttcgggcggtaccgtattaaccggaagaaagtctaagtagtacagtacagaagtcgncgtctgagagtacgtcacgtactcgtanaagtgtagtacaatttacgaaaactaccgtactagttagtacttcgtacgtaataaacgaagaaccgacggtaacctaagggaaaacccgaggtacgaaccgggtaccttaagttacgttaagttgggaacggttaaagaaacggtaaagnggtaggacgttaagggttggttacggttacgnggttagtaacgg

SEQ ID NO: 145526 - DNA, 639 bp, Homo sapiens
  misc_feature: GYAE6OF01EYW5Y.21.4.A04.1.454.CMB.1.raw
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccaganctactacatacgcctggtaccagcagaagcctggccaggcctccccgaggttcctctactcntactcgcgtcggtccgaccgacggaccgtacgtcgacgtactaccgacgacgtacgttacgtagtacggtcgtacggtcgggtcggtacgggacgtacgtacttactactactactactactacgttacgtacgacgtacgtacggtacgtaccgtacgtaagtacgttacgtacgtacgttagttacgttacgtacgtacgtacgtacgtacgtaacgtacgtacgttacgtacctacgttcgttccggttaccggtaccggaacgggtaaccggtaaaggtaaggtaaacgtaacgtaaacgtaacgtacggtacggtacgtcgtacgtacgtacg

SEQ ID NO: 145527 - DNA, 616 bp, Homo sapiens
  misc_feature: GYAE6OF01ELHAZ.21.4.A04.1.454.CMB.1.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaanacgccacctctcctgcagctccagccagaatactccagagctactacatacgcctaggtaccagcagaacgcctggccaggcctccgagttccncatctagtgcgtcgggtcccagcggccacgtcggcactcccagacaggttcaggtcggctaggtgggtcgtgggactagtcttcacttctactatctaattacgactagtacgtggacgccgtagacgtactttcgactagttgttacttacgttgtacaagtctaaggttagtagggtaactttccaccgttccgttcggttaccggttaccgggaaccggtaaacggggtaaaccgtaaagggtaaacgtaaaaggtaacggtaaaaccggtaacgttacgggtacgggtacctacggaccgtaaccttcgttcgttacgg

SEQ ID NO: 145528 - DNA, 830 bp, Homo sapiens
  misc_feature: GYAE6OF01AWWBE.21.4.A04.1.454.CMB.1.raw
tcagtcgtcgctcgcacgaccggtgctcgatttagagtagtgatcagggggaggagctgctcagttacggacccagagggaaccatggaaaccccagcgcagcttctcttcctcctgctactctgctccagctcagaaaccacggagaattgtgttgacgcagtctcaggcaccctgttctttgtctccgaaggggaagacgccctaccttctcctgcagcctccagccaagaactactaccagacgtcctaactacgacttacggcccttacggaaccagaccaaggaacgtccgtggtacgacggtccttaccccgtaggtttccctactacgttccttaagtcggtaccggttccgggtacccaaccggtacggggaccctaaccggttccgggaccctaaccgtaccccggaaacggtaccgttaaacgggttcgtacggggttacgggaccggtaggggtttccggggttacggtacggggaacctaacggtaccctttaccgaccgttacctacttacctacgttaagttaacgaccgaaacggttaccgggtacggtaacgtaccgttaagggttaacttcggtttaccgtacgttaggtttacgttacttttacggtcgtaaccgaggttacgttaaggttaacggtacggttaaaccgtttcccgtaacgtttcgggtttaccgttacccgggttaccggggtaaccggtaaacgggttaaacccgggtaaagggttaaacgtaaacgggttaaacggtaaaccgggttacgttagggtaccggtaacgcgttaaacctacccgttagttcccgtttaccg

SEQ ID NO: 145529 - DNA, 581 bp, Homo sapiens
  misc_feature: GYAE6OF01EKEB8.21.4.A04.1.454.CMB.1.raw
  modified_base (216)..(216): a, c, t, g, unknown or other
  misc_feature (216)..(216): n is a, c, g, or t
  modified_base (410)..(410): a, c, t, g, unknown or other
  misc_feature (410)..(410): n is a, c, g, or t
  modified_base (509)..(509): a, c, t, g, unknown or other
  misc_feature (509)..(509): n is a, c, g, or t
  modified_base (551)..(551): a, c, t, g, unknown or other
  misc_feature (551)..(551): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggacgggtccctgacgactctcctgtgcagccctctgcattccaccttcagtcgaccacaacatggacgtcggggtcccgccgagggcctaccggaggggaacggggtctgggaggtggggtaccggaccgttaagtacgaaaggaacgctaaacgagttacagtacagaatacgggcncggtctaggtaggaaaggtagttcacctatctacgaagagatgaattacgaaagtactctatgtatctagacaaagtgaacagtacctaaggaaaccgnggaccacggcctagttattagttggtaggtaagaacaaaggngtaggagttggtggtaggtagtcgtgtacg

SEQ ID NO: 145530 - DNA, 722 bp, Homo sapiens
  misc_feature: GYAE6OF01BUF9P.21.4.A04.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagctccagccagaatactccagacgctactacatacgcctggtaccagcagaacgcctggccaggcctcccgaggttccncatctatcgccgtcgggtcccacgacgggccacgtcggactactcccgagtaccgtaaggtttccgaaggttcgggacgtagggttcggggtacctacgggggaacctaagggtacctttccgaaccgtttccgtacctaagttaccgtaagtttaacggaccgtaacggtacgttacgggaacgtacccgttaaggtaaacgttacgttttaccggacgttaggtttagttaacttttacgtcgttacgaaggtacgtaaggttacgttacgggttaacgtttcccgtaaccgtttcgttcggtttaccgggttaccgggtaaccggtaaacgggtaacccgtaaagggttaaacgtaaacggttaacggtaaaaccgtaacgttggttacggtccgttacgaacctaaccgtagttccgttacg

SEQ ID NO: 145531 - DNA, 930 bp, Homo sapiens
  misc_feature: GYAE6OF01C2CL9.21.4.A04.1.454.CMB.1.raw
  modified_base (117)..(117): a, c, t, g, unknown or other
  misc_feature (117)..(117): n is a, c, g, or t
  modified_base (210)..(210): a, c, t, g, unknown or other
  misc_feature (210)..(210): n is a, c, g, or t
tcagtcgtcgctcgcacgaccggtgctcgatttagagtagtgatcagggggaggaggctgctcagttaggacccagagggaaccatggaaaccccagcgcagcttctcttcctcctncctacctctcggcctcccaggctcagaaaccaccggagaaattgtgttgacgcagtctccaggccaccctgtctttcgtctccgaggggaaanacgccaccctctccctgcagcctccagaccaagaatatccagacgtctactacatacgcctggtaccagcaaggaacgccctacggacccagggtaccctaccccgaacggtttccctacgtacttactaacgttggccgttacggggtcccccaacgtacgggggacccctaacggttcgggacctaacgtttccccgaagtaaccggttacgggttttacccaagggtttaccgggaccgtaaggggttccggggttaccgtacgggggaacccaacgggttaacctttcccgtaaacctttccgttacccgtaagttacccgtaaacgttttacgggaacccgtaagggtaaccggttacggggtaaaccggtcccgtttaaagggtaaaaccggttttaacctttaccgggtaaccggttaaacgggtttacggttttaaactttttaaaccgttacggttaaccgtaacgggtaacccggtaaagggtttaacggtttaacggggggttaaaccgttttcccggaaccggttttacccgggttagggtttacccggggtttaaccccggggaacccggttaaaacgggggacccggttaaaaggggtaaaaccgtaaaaacggtttacgggaaaaaccccgttaccggttcgggtttaaccggtacccggttaaccgtaccccgttaaacccgtacgtttcccggtttaaccccg

SEQ ID NO: 145532 - DNA, 649 bp, Homo sapiens
  misc_feature: GYAE6OF01A9KPZ.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaacccaccggagaaattgtgttgacgcagtctccaggcaccctgtctttgtctccaggggaaagagccacctctctgcagctccagccagaatactccagcgctactacatacgcctggtaccagcaagaagcctggccaggcctcccgaggttccctcgatctatcgcttcggggtcccacgacgggcccacgtgggccacgtccccaagtaccgtagggtttccagggttcggacgtagggttcggggtctgggggaacctaggtacctttcaaccttctacgaattcaagtttagccgaagaccgtagggaacgtcccgtaggtaaaggttactttacggtctaggtttagttaactttacgtgtaccagtactaggttagtagggtaacttccaccgttcgtacgttccgtacgggaccgtaaacgggtaacctaaagggtaacgaaagttacggaaaacgtaacgttaggtacggtccgttacggaccctaacgtacgttcgttcg

SEQ ID NO: 145533 - DNA, 604 bp, Homo sapiens
  misc_feature: GYAE6OF01BF34Y.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatatccagagctactacatagcctggtaccagcagaacgcctggccaggcctcccgaggtttccctcattctagtcggccgttcgggtacccacggacgggcctacgtcggcactcccagacgtaggttcaggtggcagggtcgggtctaggggactaggtaccttcacttctactatctagttacgacgagtacgtggacgtccgtagtaacgtacgtttacgacgtagttacgttattacgtgtacgagtacgtagttagtagtaacgttctacgttcgtcgttaccggttcggaccgtaacgggaaccgtaaggtaacgtaaagtacggtaaacgtacgtaggtacgtacgtacgacctactgttcgtacg

SEQ ID NO: 145534 - DNA, 603 bp, Homo sapiens
  misc_feature: GYAE6OF01CDW3L.21.4.A04.1.454.CMB.1.raw
  modified_base (202)..(202): a, c, t, g, unknown or other
  misc_feature (202)..(202): n is a, c, g, or t
  modified_base (450)..(450): a, c, t, g, unknown or other
  misc_feature (450)..(450): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaangccaccctctcctgcagcctccagccagaatatccagagctaactacatagcctaggtaccagcaagaacgcctggccaggctcccaggttcctcatctatgccgtcggggtccccacgacgggccctacgtcggacactcccagtacctaggttacaggtcggactagggtgggtcgtagggacagtacttcgacttctcatctattacgcagtacgtggacgacctagaagtatttacgctagttnttattacgtgtacagtctaaggttagtagggtaacttcctaccttcgtcggttacggttccggacgtaaacgggtaaccgtaaagggtaaacgaaagttaacggaaacgtaacgttaggtacggtccgtacgacctaaccgtgttccgttacg

SEQ ID NO: 145535 - DNA, 662 bp, Homo sapiens
  misc_feature: GYAE6OF01BW815.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagcctctgctattcctaccttcagtcgacccacaacagtcggacgtcggggtcccgccgacgggcctaccggagggggaacggggcgtaggggaggttcggggtccggtaccggttaagttaaccgaaaggaaacgacgtaaacgtaagttaacaggtaacaagaacgtaccgggcgtcgtacgtgtaaggaaaggtaacggttcaaccgtatacgtacgaaaggtagaattaggaacttaacaaacgtaactacgtactagtactctagacgtaaactacggaaccagtaccgtaacggaaaaccggcgaaccgaccggtcgttagttaatttagttaggtaggtaacgaaaggtaaaaggtaggtaggtagttggtagggttgggtaaggtgtggtaccg

SEQ ID NO: 145536 - DNA, 775 bp, Homo sapiens
  misc_feature: GYAE6OF01CO13Y.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgagggaaangccaccctctcctgcagcctccagccagaatactccagacgtctaactacatacgccgtaggtaccagcaagtaacgcctggccaggtccctccgacggttcctacgacttcttagtcgcgtcgggtcccaagacgggacctaacgtcggacctaactccccgagtaaccgtacggttcgaaggttcggacgtaggttcggggtacgtacgggaactacggtaactttccgtaacctttccgtacgtacttaccgtaagtttaacggaccgtaacgtaaccggtcgggtaaacgtacccgttaaaggtaacggttaacgttttccgggaacttaaggtttacgttaagttttaacgtacggttaaccgtaacggtaaccgtaagggttaacgttaacggggttaacgttttcccgtaaaccgttcgtttaccgggttaccggttacccgggtaaccggtaaaaccggggaaccgttaaaacggggttaaaacggtaaagtaaccgggttaaaaaccggtaacgttacggggttacgtaaccggttacaaacccgtaaccttacgttcggtttaaccg

SEQ ID NO: 145537 - DNA, 642 bp, Homo sapiens
  misc_feature: GYAE6OF01EJL5A.21.4.A04.1.454.CMB.1.raw
  modified_base (219)..(219): a, c, t, g, unknown or other
  misc_feature (219)..(219): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagtcgtcgctcgcacgaccggtgctcgatttagagtagtgatcaggggagctctgagagcggagcccccagcccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagcctggacgggtccctgacgactctcctgtgcagcctctgctattccaccttcagtcgaccacaacatggactgggtcccgcgaggcctcgagggagggctggagtggtcgcgtatacgaaggaanctaangtacagtacagtaatacggcgcgtctaggaggaaaagggtacggttaccaacctatcgtaacgaagagtattaggaacttaacgaaagtaacctctacgtatatactagaactaaacgtagaaacgtacgacccttaaagggaaaacccgacgggaaccgaaccggggtaccgttaagtttaagttaacgtttagggtaaggttaaacggaaacgtaaaaagggtaacgggttagggtaacgttaggggttacgggtagggttacgtacggttgggtaccgg

SEQ ID NO: 145538 - DNA, 635 bp, Homo sapiens
  misc_feature: GYAE6OF01AVMZ9.21.4.A04.1.454.CMB.1.raw
  modified_base (200)..(200): a, c, t, g, unknown or other
  misc_feature (200)..(200): n is a, c, g, or t
  modified_base (243)..(243): a, c, t, g, unknown or other
  misc_feature (243)..(243): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaggggaaancgcccaccctctcctgcagcctccagccaagaatatccagacncctaactacatacgcctaggtaccaggaccaagaacgccgtggccacggcccttccccgtacggtttccctactacttctagtcgtcgttcgggtaccccacggacgggaccctacgtcggacctaactcccgaagaccgtaggttcaggtggcgtagggtcggtacgtacgggacacgtaccttcgactcgtcatctagttacgactacgacgtggtaccgtcgtaacgaagttacgttccgagtacgtacgttagttactaggtacaagtctaaggttgtagttacctcgacgtttcgtacgttccggtacgaccgtaacgggacgtaaggtaaacgtaagttacggaaacgtacggttcgacggtactacggactaccgtgtcgttacg

SEQ ID NO: 145539 - DNA, 675 bp, Homo sapiens
  misc_feature: GYAE6OF01C9XZR.21.4.A04.1.454.CMB.1.raw
  modified_base (201)..(201): a, c, t, g, unknown or other
  misc_feature (201)..(201): n is a, c, g, or t
  modified_base (512)..(512): a, c, t, g, unknown or other
  misc_feature (512)..(512): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggccacctgtctttgctccgaaggggaanctccaccctctcctgcagcctccagccaagaatactccagacgtctaactacagtacgcctggtacccagcaagaacgcctggcccaggcctcccgtaaggtttcccactatctagtcgccgttaccgggtcccacggacgggtcctacgtcggacctactcccgagacgtacggttcagggtcggacgtagggttcgggtcggtcggggactacgtaccgttcctaaccgttctacagttacctaagttacggcctacggaacgttgggacctaccgttaaggtaacgttcgtttcggaacgttagtttnttaactttcgtgtaccaaggtcgtaaggttacgtttaacggtaacgtttcccgacgtttcgttaccgtaccgggttaccggaacggtaaacgggtaaccaaagggtaacgtaaaagtacggaaacgttaagtggtacgcttacgaccctactagttcttacgg

SEQ ID NO: 145540 - DNA, 607 bp, Homo sapiens
  misc_feature: GYAE6OF01B8GS0.21.4.A04.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgctccaggggaaanagccacctctcctgcagctccagccaagaatactccagagctactacatagcctggtaccagcagaagcctggccaggctcccgaggttccnatctatcgctcgggtcccagacgggccacgtggcactcccgagactaggtcagtcggcagggttggtcgtagggacaggtacttcacgtctactatacgtattagacgagtacgtaggacgtacctaggaacgtactttcgacgtagttagtaactttacgtcgtacagactaaggtagtagggtaagttacctaccgttcgttacggttaccgttacgggacccgaaagggtaaacccgtaaagggttaaacgtaaaagtaacggtaaaacggtaacgttaggtacggtactacgaccgaaccttagttccgttacg

SEQ ID NO: 145541 - DNA, 668 bp, Homo sapiens
  misc_feature: GYAE6OF01BDJRF.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaancgcccaccctctcctgcagcctccagccaagaatactccagacgctactacagtacgcctaggtaccagacaagaacgccgtaggccaggtcctacccgtaggttcctcgtatctatcggtcgtcgggtcccacggacgggccacgtggaccactcccgagacgtaggttcaggtggcgtagggtcggtcgtgggactaggtaccttcgaacttcgtactaatcgtaacgttacgacgtaacggtaacgtacgggaacgtaccgttaggtaacgttacgtttacggacgttagttacgtttacttacgtcgtactaacggtacgtaagttaggtacggtaacgttaccgtaccgttacgttcggttaccggttaccgggaccggtaaacggtaaccggtaaagggtaacgtaaaagttacgggaaacgtacgttggtacgtaccgtacgaacctacgtgttcgttacg

SEQ ID NO: 145542 - DNA, 730 bp, Homo sapiens
  misc_feature: GYAE6OF01ANKQ6.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagtagtgttggcatcgacgttgccgttaggtaaccaaacaaaacctcggaccgacggcctccagtcctcctcatcgtagtcggggctacgtcctacgaggtactcggaccggacactcccgagtacgtaggttcaggtcgccgtaggtcgggttcgtacgggaactacggtaccttccgtacgtctaccacctactaccaacctaccgacgtcgggccgtaccgttacggaagttacgttttcgacgttaagttacgtttaacgtttcgtacggttacgtaaggttacgtttagggttaacgttacggggttaacgtacccgtaacccggttaccgttaacccggttttaccgggaacccgggtaacggggtaacccggttaaggggtacgggtaacgtaacgtaccggaacggtaaccgttaacggtggtaccggtaccgtacggaccttaacccgtgtttacccgttacgtttacccgttactacccgtttccccgtcccgttacccg

SEQ ID NO: 145543 - DNA, 739 bp, Homo sapiens
  misc_feature: GYAE6OF01BWSS3.21.4.A04.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagcctccagccagaatacnccagagctactacatagcctggtaccagcagaacgcctggccaggcctcccgaggttccctcactctatgccgtcgggtacccagacgggcccacgtcggaccactcccgaagaccgtaggttccgaggttcgggaccgtagggttcgggttacgtcggggactacggtacctttcaaccttcgtacattaccgtattacgactagtacgtacggacgtccgtaaggtaagtacgttttaccgacttaggtttacgtttaacgtttacgttcggtacgtaacgtcgtaaaggttacggttagggttaaaacggttttccctaaccgtttccgttacgggttacccgggtttacccgggggtaaccggtaaaaccggggggtaacccggtaaaaggggttaaaccggttaaaaaggtaaccgggtaaaaacggttaaacggttacggggttacgggttactaccgggaacccttaacccggtaagtttcccgtttaacccggg

SEQ ID NO: 145544 - DNA, 623 bp, Homo sapiens
  misc_feature: GYAE6OF01BQX8M.21.4.A04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaangccaccctctcctgcagctccagccagaatactccagagctactacagtacgcctggtaccagcaagacgcctggccaggcctccgaggttccnatctatggcgtcgggcccagagggccagtgcactccagcaggttcagtgcaggtcggtnagggacagtcttcacgtctacactctagttacgacgtacgtacgtggaacgtcgtaagaacgttatttcgacgtagtttagtacgtttactggttacaggtacgtaaggttagttcggtaacgtttcctaccgttcgttacggttccgggttaaccgggaccgtaaacggggtaacccgtaaagggttaaccgtaaaggttaaccggtaaaaccgtacgttacgggttacgggtaccgttacggacctaaccgttgttcccggttaaccg

SEQ ID NO: 145545 - DNA, 599 bp, Homo sapiens
  misc_feature: GYAE6OF01EEI6S.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttccncatctatcggcgttcgggtcccacgacgggcccacgtcggccaactccccgaagtaccgtaggtttccaggtgggcctaggttcgggtctggggacaggtaccttcactctcatctattacgcagacgtggacgcctaggaagtagtttcgactagttgttacttacgtgtacgagacgtaagttagtagggtaacgtttcaccgttcgtcggttccggttaccggaccgtaaacgggaaccgtaagggtaacgtaaagtacggaaaacgtacgtagggtacggtcgtacgacctaacctgtcgttacg

SEQ ID NO: 145546 - DNA, 588 bp, Homo sapiens
  misc_feature: GYAE6OF01C50EG.21.4.A04.1.454.CMB.1.raw
  modified_base (216)..(216): a, c, t, g, unknown or other
  misc_feature (216)..(216): n is a, c, g, or t
  modified_base (311)..(311): a, c, t, g, unknown or other
  misc_feature (311)..(311): n is a, c, g, or t
  modified_base (411)..(411): a, c, t, g, unknown or other
  misc_feature (411)..(411): n is a, c, g, or t
  modified_base (452)..(452): a, c, t, g, unknown or other
  misc_feature (452)..(452): n is a, c, g, or t
  modified_base (473)..(473): a, c, t, g, unknown or other
  misc_feature (473)..(473): n is a, c, g, or t
  modified_base (547)..(547): a, c, t, g, unknown or other
  misc_feature (547)..(547): n is a, c, g, or t
  modified_base (581)..(581): a, c, t, g, unknown or other
  misc_feature (581)..(581): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggagggtccctgagactctcctgtgcagccctctgctacttccaccttcagtcgaccacaacattgggactggggtcccnccgaggcctccggaaggggaacggggctaggggaggtcggggtccggccgtaattaaccgaaggtaaagctaaacgagttacaagtacaagaatacgggngcgtcgtggaggaaagggaggttacaccgtatctacaaganatgaatacaaagaactcactntagtctagacaagtagaacacgtacctaagaaacccgaggaccgacggtccgttagtagttagtggtaggtaanaacgaaaaggtagtaggagtggtaggtaggtagngtcgtag

SEQ ID NO: 145547 - DNA, 612 bp, Homo sapiens
  misc_feature: GYAE6OF01A1KP5.21.4.A04.1.454.CMB.1.raw
  modified_base (199)..(199): a, c, t, g, unknown or other
  misc_feature (199)..(199): n is a, c, g, or t
  modified_base (442)..(442): a, c, t, g, unknown or other
  misc_feature (442)..(442): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaanagccacctctcctgcagctccagccagaatactccagagctaactacatacgcctggtaccagcagacgcctggccaggcctcccgaggttccctacatctagtcgtctcggggtacccagaacgggccacgtggcctactccccgaagtaccgtacggttcaggtcggcgagggtcgggtctggggacagtacttccgacttctacgatctattacgacgagacgtaggacgctagaacgtnttcgcgtagttacgttactacgtgtcagtactaggtagtagggtaagtttccgaccgttcgttcggttccggttaccggaccggtaaacgggaaccgtaaagggtaagtaaagtaacggtaaacggtaacgtcggtacggtcgtacggtaccaccgttagtccgttacgg

SEQ ID NO: 145548 - DNA, 670 bp, Homo sapiens
  misc_feature: GYAE6OF01A4ILG.21.4.A04.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaaancgccacctctcctgcagctccagccagaatatccaganctactacatacgcctggtaccagcaagaacgcctggcccaggcctccaggttccnatctatggtctgggtcccacgacggccacgtcggcactcccgaagacgtaggttcaggttggactagggtcgggtctaggggaactagtacctttcaccgtctactaattcaagtttacgacgtaacgtacgttagggaaccgtccgtaggaaacgttacgtttacggtactaaggtttacgtttaacgtttacgttcggttaactaggtacgttaaggttaacgttagggtaaacgttttcccgaaccgtttcggttacggttccgggtttaccgggaccgtaaaaggggaacccgtaaaggggtaacgtaaacgttaacgggaaaaccgttacggtaggttacggtacgtacggtacaaacccgttgtccgttacg

SEQ ID NO: 145549 - DNA, 804 bp, Homo sapiens
  misc_feature: GYAE6OF01CCCAA.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggcaccctgtctttgtctccgaggggaaanacgccacctctcctgcagctccagccaagaatactccagagctactacatacgcctggtaccagcaagaacgcctggaccacggcctccccgtaggttcctcattctatcggtcgtcgggtcccagacgggcctacgtcggactacgtacccgagtaccgtaggtttcgaacggtcggacgtaggggtcggggttacgtagggggaacctacggttaacctttaccaccgttctaaccgtactttacgtaacgtttaacggaccgtaacgggtaaccgttcgggtaaaccgtccggttaaaggtaacggtttaacgttttacccgggacgttaacgggtttacgtttaacgttttaccgtttacggtaccgtaacggtacggttaaggtttaacggttaacggggttaaccgtttaccgtaacccgtttccggttacggtttacccgggtttaccgggaaacccgggtaaaaccggggtaacccggtaaaaacgggttaaacgggtaaaaacggttaacgggtaaaaaccggttaaccggttacggggttacgggtaccgttaaccgggaaccgttaacccgtaagtttcccgtttaaccggg

SEQ ID NO: 145550 - DNA, 628 bp, Homo sapiens
  misc_feature: GYAE6OF01C6I9L.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaagcgccaccctctcctgcagcctccagcccaagaactatccagacgactactacatacgccttggtaccagcagaagcctggccaggcctcccgaggtttcctcgacttctatcgctcgggtacccagacgggccacgtcggcacgtcccagacctaggttcagtcggctaggtcgggtctaggggactagtacctttcgacttcctcattactaacgttagacgtagtaccgtggacgtccgtagtaaacgtcgtttacgctaggtacgttattacgtgtacagtcgtaagttagtagggtaacttctaccgttcgttgttccggttaccggaaccggtaaacgggtaacctaaagggtaaacgtaaagttaacggaaaaccggttaacgttggtacggtccgtacggaccaacctacgttcgttaccgg

SEQ ID NO: 145551 - DNA, 866 bp, Homo sapiens
  misc_feature: GYAE6OF01DHF6S.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagtacgttggtccagccgtgggacgggtccctgagactctcctgtgcacgcctctgctacttcctacccttcacgtcgaacccaacaaacagtacggggacctcggggtcccgccgacgggcctacccgggaaggggggaacggggcgtaggggtaacgggttcgggggtaccgggacccgttaagttaaacggaaaagggaaaacgtccttaaaacgtaacggtttaaccgaaagttaaaccgaaaggtaaaacggttacccggggaccggtacggttaccggttagggtaaacggggtaaaacggggtaaacgggtttcccaaacccgtacgttaccgtaaccgaaaagggtacgtaaacgttaggtaaacctttacggaaaaaacgttaaccttacccgtaagtttacggttaacttacctttaagggaaaccctaaaagttacggaaaaaccctaacggtaacccgttaaacgggaaaaaaccccgggtacgggaaccggtaacccggggttaccgttaagggttaaacgttttaagggtttacgggttaaacggggtaaacgtaaaacggaaaaagggttagggttacggggaagtttacggggttacggggtttagggtaacggtcggtttacgggtaaaccgg

SEQ ID NO: 145552 - DNA, 561 bp, Homo sapiens
  misc_feature: GYAE6OF01A1W8S.21.4.A04.1.454.CMB.1.raw
  modified_base (476)..(476): a, c, t, g, unknown or other
  misc_feature (476)..(476): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtcccgccaggcctccgagggaagggcgtgggagtgggtcggcgtatacgaaggaagctaacagttacagtacaagaactacggcgcgtctgtagaaaggagttcaccatctacaagagatagattacaaagtactcactgtactctagacaaatcgaaacacgtacctaagaaaaccgnggaaccacggccgtagttattagttggtaggtaagaacgaaaaggtaggtaggaagttgggtagggtaggtacgtcgtggtaacg

SEQ ID NO: 145553 - DNA, 919 bp, Homo sapiens
  misc_feature: GYAE6OF01A1L7P.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaagngccaccctctcctgcagctccagccagaatactccagacgctaactacatacgcctaggtaccagcaagaacgccgtggacccagggtccctccccgtacggtttcccctacgtaacttccttaacgtcggtccggtttaccggggtacccccaacggaacgggggtcccctaacgttcgggaccctaacgttccccgaaggtaaccggtaacgggtttaccgaacggggttcggggaccgtaagggggtttaccgggggtaccgtttacggggggaaaccctaacgggttaaccgttttacccgaaccgtttacccggttaccaaacgtttacccgttaaacggtttaaccggtaaccgtaacgggttaacccggttaacggggtaaaccggtaccccggtttaagggttaaaaccgggttaccgtttttaccgggaaccgtttaaacgggtttacgtttaaccgttttaaccggttacgggttaaccgtaacgggttacgttaaagggtttacggttaacggggttaaaccgtttaccgttaacccggtttaccggttacgggtttacccgggttaccgggtaaacccgggtaaaaccggggtaaacccggttaaaaaggggttaaacggtaaaaacgggttaacggtaaaaaccggtaacggttacgggtaccggttacggtaccgaaccgtaaccgttacgttccgtttaacgg

SEQ ID NO: 145554 - DNA, 809 bp, Homo sapiens
  misc_feature: GYAE6OF01CMNKH.21.4.A04.1.454.CMB.1.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccacggagaaattgtgttgacgcagtctccaggcacctgtcttgtctccgaggggaaancgccacctctcctgcagctccagccaagaatacnccagacgactaactacatacgccgtacggtaaccagcaaggaacgccgtagggccaacggcctaccccgtaagggtttccctacaacttctaatcggtcgttcggggtaccccacggaacgggccctaacgttcgggaccacgtaccccgaaggtaaccgtaagggtttccaagggtcgggaccgtaaggggtttcggggttacccgtagggggaaccctaacgggttaaccctttaccgtaaccttccgtaccgtaacttaccgtaacgtttaacggaccgtaacgtaaccggttacgggaaccggtacccgttaaggaaacggttaacgttttaccggaccgttaaggttacgtttaacgtttaccgtagttaccgaacggtacgtaaacggttaacggttacggggttaaacgtttacccgtaaccgtttaccggttacgggtttacccggttaccggggtaacccggaaaacggggtaaaccgtaaaaggggttaaacgaaaaggtaacggtaaaaaccggtacggttaagggttcgggtacgtacgaaccctaacgtcgtttaccgttaccgg

SEQ ID NO: 145555 - DNA, 930 bp, Homo sapiens
  misc_feature: GYAE6OF01B5J97.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcagggggaggagctgctcagttaggacccaggagggaaccatggaaaccccagcgcagcttctcttcctcctgctactctggctccaggctcagaaaccaccggagaaattgtgttgacgcagtctccaggcaccctgtctttgtcctaccgaggggaaancgccaccctctcctgcagcctccagccaagaactacgtccaagacgactaactacagtacgtccttaggtaacccaaggaccaaggaaccgtcccgtacgggacccgaacgggtccccgttaccccgtaacgggtttccctactaacttaccgttaacgtccggtccgttaccggggtaccccacgggtaccggggccctaacggtcgggaccctaaccgtaccccgaaggaaccgttacggtttacgacgggttcgggaccgtagggttccggggttaccggtaacggggaacctaacggttacccgtttaccgtaacccgtttccgtaaccgtaacgttaacccgttaacggttaccggtaacgtaaacgggtaacccggttacggggtaaacccggttaccggttaaacggggttaaaaacggtttcccgggtttaaccgtaacggttaaccggtttaagtttaaaccgttttaaccgttacgggtttaaccgtaacggttaacggttaaacgggtttaaggttaccggggttaaaccgtttacccgttaacccgttttcgggttaccgggtttacccgggtttaacccggggtaaccgggtaaaaccggggtaaaccgggtaaaagggttaaacggtaaaacgttaacggggtaaaaccggttaccggttagggaccggtacgttacccggaaccgtaccttaacggttccgttaacccgg

SEQ ID NO: 145556 - DNA, 649 bp, Homo sapiens
  misc_feature: GYAE6OF01EZUTW.21.4.A04.1.454.CMB.1.raw
  modified_base (215)..(215): a, c, t, g, unknown or other
  misc_feature (215)..(215): n is a, c, g, or t
  modified_base (313)..(313): a, c, t, g, unknown or other
  misc_feature (313)..(313): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagctggtggagtcgtggggganacttggtccagccgtgggacgggtccctggagactctcctgtgcagcctctgcattccaccttcagtcgaccacaacatggacgtcgggtcccgccgnggcctcggagggaggggctagggagtgggtccggcgttatacgaaggaacgactaacgagttacaagtacgaagaacgtaccgggcgtacggtctaggtaaggaaacgggtaggttaccaacctagtctacaaggacgtatagtaattacaaagtaacctactactagtactctagaactaaatacggaaccacgtaccgtaaacggaaaacccgacggaaccgaccgggtaccgttaggtttaacgttaggttacggtaagggttaacgaaaccggtaaaaggtacggtaagggtacgttagggtagggttagggtacggtcgttagggtaacgg

SEQ ID NO: 145557 - DNA, 826 bp, Homo sapiens
  misc_feature: GYAE6OF01EMARU.21.4.A04.1.454.CMB.1.raw
  modified_base (148)..(148): a, c, t, g, unknown or other
  misc_feature (148)..(148): n is a, c, g, or t
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaaattgtgttgacgcagtctccaggccaccctgtctttgctacgaggggaaancgccaccctctcctgccagcctccagaccagtaatacgtccaaggacgtaccttaactacagttaaccgtccgtacggttaacccaaggaccaaggtaacggcccgttacgggacccgaacgggtcccttaccccgtaagggttttcccctaccgtaacgttaccttaaggttccggtcccgttaccggggtaccccgaaccggtaccgggacccgtaccggtacgggtaccctaaccgttaccccgaaacggtaccggttaacggttccggaaaggttccggggtacgtaacggggtttcgggtacggtacggggtaaccgtaacgtacctttaccgaaccgtttccgtacgtacttactaacgtttaacgacgtaacggtacggtacgggaacgttacccggtaagtaacggttaccgtttacggacgttacggtttacgttaactttacgttacgtacgtacggtacgttaaggttaacggttacgggttaaacgttcccttaccggtttacgttcggttaccggtaccggtaccggtaaacgggaacgtaaagggttaacgaaacggtaacgtaaacgtacggtcggtacgtccgtacgtaacctaccgtgttccgttacg

SEQ ID NO: 145558 - DNA, 662 bp, Homo sapiens
  misc_feature: GYAE6OF01ARDAX.21.4.A04.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (292)..(292): a, c, t, g, unknown or other
  misc_feature (292)..(292): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcacctgtctttgctcgagggaancgccacctctcctgcagctccagccagaactanccagacnctaactacatacgcctaggtaccagcagaacgcctggccaggcctccgagttccnatctatcgcgtcggacccagacgggccagtcggacacgtacccgagtaccgtaggttcaggtcggcgtagggtcggggtactagggaactaggtacctttcgaactctactatactaagttacgcgtaagtacgtacggacgtaccgtaagtaacggttactttacggacgtacggtttacgttaacgtttacgttaggtacgtaggtaccgtaaggtttaacgtacgggtaactttacccgtaccgttcggtttaccgggttaccggtttaccgggaccggtaaacgggaaccgtaaaggggtaaacgtaaagtaacggaaaccgttacggtggtacggtacttacgaccctacttacgttcgttaccg

SEQ ID NO: 145559 - DNA, 690 bp, Homo sapiens
  misc_feature: GYAE6OF01A626U.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaagggaagcgccaccctctcctgcagcctccagccaagaatactccgaagacgactaactacatacgccgttacggtaccagcaaggaacgccgtcggccgacggtcctaccccgtacggtttccctactacttcttagtcgtccggttcgggtacccacggacgggccacgtcggccacgtcccgaggacgtacggttcaggtcggcagggttcgggtcgtagggactacggtaccttcgaccttctactacttacgtaattacgacgtaacggtacgtaggacgtacgtaacggtaacgttacgtttcgacgttaaggtttagttaacgtttacgtcgtacgtacggtacgtaaggttaggtacggttaacgttacctaccgtttacgttcgggttacgttccgggaaccgtaacgggtaaacccggtaaaggtaacggtaaagtaacggtaaaccggtagtaggtacggtacgtacgaacgtacctagttctacgg

SEQ ID NO: 145560 - DNA, 698 bp, Homo sapiens
  misc_feature: GYAE6OF01AG0D2.21.4.A04.1.454.CMB.1.raw
  modified_base (143)..(143): a, c, t, g, unknown or other
  misc_feature (143)..(143): n is a, c, g, or t
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (299)..(299): a, c, t, g, unknown or other
  misc_feature (299)..(299): n is a, c, g, or t
tcagtcgtcgctcgcacgaccggtgctcgatttagagtagtgatcaggggagagctgctctagttaggacccagaggaaccatggaaaccccagcgcagcttctacttcctcctgctactctggctcccaggctcagaaaccncggagaaattcgtgttgacgcagtctccgaggcaccgtgtcttgctcgagggaancgccacctctccgtgcacgcctccagccagaactcnccgagcnctactcacgtagcctcggaccagcaggaacgcctcggaccaggcctcccgagttcccncgtagtccagtcgtccgtcgggtacccacgtaccgggcctacgtggcctacgttccccgaaggtaccgtacggtttaccgacgggttacggacccgaagggtttcggggtacgtaggggaaccctacgggtaccctttcgaccttcgtacgtactacgtaagttacgcgaacgtacggtaggtacgtacctaaggtaacgtacgtttccgacgttacgttaagttacttacgttacgtccgaagtccgtaggttacgtaacgggtaacttccgttacgttcgttacggtaccggttaccggaccggtaaaccgggtaaccgtaaggtaaacggtaaagtacggaaaaccgtacggtacggtacgtaccggtcgaacctaccgttaagttccggttaccg

SEQ ID NO: 145561 - DNA, 755 bp, Homo sapiens
  misc_feature: GYAE6OF01DTYCS.21.4.A04.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctacaacgaaaccgaccggaagtaaattgtgttgacgcagtcctccgaggcctacccttgttctttcgtctaccggaaggggaaacncgcccaccctctcctagccacgtcctaccgacgaccaagtaactacgccaaggacaccttacacataccggtacctacggtaccagacgaagaacgccgtcggaccgacggtcctacccgtacggtttcccatacttacgttactccggtccgtccgggtacccacggaccggtacctaacggtcgaaccgtaccgtaccccgtaaggtaaccgtacggttacgacggggtcggacggttacgggtcggggttaccggtacggggaacctacggtttacctaccgtactactccgtaattacgtacgttacgaccgttaaggtacggtacggtacgtaccgtaagggtttaactacgtttacggtactttaaggtttaccgttaattccggttagtacgtacggtaccgttaattacgggtacggttaactttcccgtacggtttcgtaccgtttcggaacggaacgtacgggaactaaggtaacgtaaagacgtaaacgaggttcggtactacggtacaacctcgttagtcttcg

SEQ ID NO: 145562 - DNA, 732 bp, Homo sapiens
  misc_feature: GYAE6OF01BRZMC.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacttggtccagccgtgggacgggtccctggacgactctccgtgtgcacgcctctgctattcctaccttcgacgtcgaaccacaacagtcgggacgtcggggtcccgccgaggccgtacccggaagggggaacggggtccgtaggggaggtcgggggtccggtaccgttaagttaaaccgaaaggaacgtacgtaaacgtaacgttaacaagtaacaaggaagtaccggcgtacgtcgtaggtaagggaaagggtacgttaccaaccctattaccgtacgaaaggagtaagtagtaacttaacgaaaacgtaacctactacgtagtacttacgtagaacaaagttacgaaaccgtacggacccgttaaacggaaaacccggaacggtaacccggaaccgggtccggttaagtttaaagtttaacgtttgggtaacgggttaaagaaaccggtaaaaagggttggtagggttaacgttacgggttaggggtagggttacgtgttacggggtaaaccg

SEQ ID NO: 145563 - DNA, 729 bp, Homo sapiens
  misc_feature: GYAE6OF01BWEOJ.21.4.A04.1.454.CMB.1.raw
tcagtcgtcgctcgcacgaccggtgctcgatttagagtagtgatcaggggagctctgagagcggagccccagccccagaattcccaggttgttttcatttggtgatcagcactgaacacagaggactcaccatggtagtttgggctgagtcgttgggttttccttgttgtttatttacgaaggtgtccagtgtgaggtgcgagcgtggtggagtcgtgggggatacgttggtccaggccgtgggacggtccctgacgactctcctggtcgcagtcctctcgctattcctaccgttcacgtacgaaccaacaacgacgtcgggacgtcgggtcccgaccgacggcctaccggaaggggaacggggtcgtagggacgggttcggggtaccggtaccgttaagttaaccggaaaaggaaacgtactaaacgtagttaacgaacggttaaacgaaggtaaacgtaccgggtcgtacgttacgtaaggtacggaaaaggttacggttaccaaaccgtagttaccgtaacgaaaaggactaagtacgtaaacgttaaccaaaacgttactactaacgttgtaaatcgtaacgaactaaagtacggaacaacggacccgtaaaaggaaaaccgcggaaccgacggttcgttaagtaatttaggtacggtaaggtaagaaaaccgtaaagggtcggttaggaagttgggttacgggtaaggtcttcgtaggtaaccg

SEQ ID NO: 145564 - DNA, 866 bp, Homo sapiens
  misc_feature: GYAE6OF01EJEMZ.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaagcgccacctctcctgcagcctccagccagaatactaccagacgtctactacatacgcctaggtaccagcaagaacgccgtacggacccagggtcccttaccccgtacgggtttccctaccgtaacttaccgttaacgtccggtcccggttacccgggggtacccccaaccgggaccgggggtacccctaaccggttccgggaaccctaaccgttacccccggaaaggtaaccggtttaacgggtttaccgaacgggggttcgggaccggttaaggggtttccgggggttaccggttaacgggggaacttaaaccgggttacccttttaccgaacccgttttacccgtaaccgtaaaccccgtaacgttaccggaaccggtaaccggtaaccgggtaaaccgggttcggggtaaacccgtacccggtttaaagggtaaacggttttcgtttttaccggaaccgtttaaacgttacggttttaactttacggttacgtaaccgtaacggttaactaaacgttccgttacccgtaacccttacccccgaaccccgttagttaccccgtacccggtaccggaacccggtaaacggaccctaccggtacctaggaccgaaggttaactaacgggtaaaccttcggtacggtacggtacctacgccctaaaccg

SEQ ID NO: 145565 - DNA, 733 bp, Homo sapiens
  misc_feature: GYAE6OF01ASRJ0.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaatgttacctctctccgtgcaaggccagtcaggagtgttggcagtcgacgttgccgtaggtaaccaaaacaaaaaccgtggaccacggcctaccctagtccttcctacacgtctaggtacggggcctattaccctacgaggacgttcggacccggactaacctacccgagtaaccgtagggtttaccaggtcgacccgtagggttcgggtcgtacggggtacaacggtaccttacggaccttccgtacaaacccgtattaacccaaaccaccgtaacggtccgggccgtaccgtaggtaacgttagttttcgacgttaagttcgttaactttaccgtgtacgaagttacgtaggttagtaggttacgtaccttaccgtacgtaccggttcgggaccgtaacggggaccgtaagggtacggtaacgtacgtacggtaaacgtaccggtaacgttcgggtcgtaccggttacgaccgtaaccggtaccgtttccgttaccggtttacttacccgtacccgtttcccgtttaccccggtaccc

SEQ ID NO: 145566 - DNA, 719 bp, Homo sapiens
  misc_feature: GYAE6OF01D0S3N.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggccaccctgtctttgtctaccgaaggggaaancgcccaccctctcctgacagcctccagccaagaatactccaagacgactactacatacgccttaggtaccagacaagaacgccgtacggaccacggccctaccccgtaggtttccctactacttcgtagtccggtccggttaccgggtaccccaacggaccgggaccctacgtcggaccctaacgtaccccgaaggtaccgttacggttcagggtcggcgtagggttcgggtacgtacgggaacctacgtaccgtttcaccttccgtagtacttacgtagttacgcgaaggtcgtaggtacgtaccgtaggtaacgttacgtttcgacgttagtttacggttaactttacggtcgtacgagtacgttaggtaacgtagggttaaccttaccgttaccgttcgttacggtaccggttaccggaaccgtaaacgggaacgtaaagggttacaaagttacggaaacgttaccgtagggtaccgtacgaccgtaaccgtacctttagtccgtttaccg

SEQ ID NO: 145567 - DNA, 644 bp, Homo sapiens
  misc_feature: GYAE6OF01BG6IV.21.4.A04.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaggggaaancgcccaccctctcctgcagcctccagccagaatatccaganctactacatacgcctaggtaccagcagacgcctggccaggcctcccgaggttccctacatctatcgccgttcgggtcccacgacgggccacgtcggacctactccccgaaggacctaggtttccgagggttcgggacgtagggttcgggtaccgtaggggactacggtacctttccgaccttctactacgttactagttacgacgtacgtacgtcggacgtacccgtaggaacgttactttacgataggttacgttacgtttacgtgtacagtcctaaggtaggtacggtagttccctacgttccgttacggttccggttaccggaccgtaaacggggaaacctaagggtaacgtaagtacggtaaaccgtagtaggtacgtcgtacgaccactgttcgtacg

SEQ ID NO: 145568 - DNA, 546 bp, Homo sapiens
  misc_feature: GYAE6OF01AWG50.21.4.A04.1.454.CMB.1.raw
  modified_base (354)..(354): a, c, t, g, unknown or other
  misc_feature (354)..(354): n is a, c, g, or t
  modified_base (435)..(435): a, c, t, g, unknown or other
  misc_feature (435)..(435): n is a, c, g, or t
  modified_base (505)..(505): a, c, t, g, unknown or other
  misc_feature (505)..(505): n is a, c, g, or t
  modified_base (538)..(538): a, c, t, g, unknown or other
  misc_feature (538)..(538): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgcattcaccttcagtcgaccacaacatggactgggtccgccaggcctccgagggaggggctgggagtgggtcggcgtatacgaaggaanctaacagttacagtacagaatacggcgcgtctgtaggaaggacggttcaaccatctacaagagatagattacaaagtactnactgtactctagacaaatacgaacacgactaacgaaaccgaggacacgtcgtagtattagtgtaggtaanaagaaagagtaggagttcggtaggtaggtacgngtggtacg

SEQ ID NO: 145569 - DNA, 730 bp, Homo sapiens
  misc_feature: GYAE6OF01BY430.21.4.A04.1.454.CMB.1.raw
  modified_base (275)..(275): a, c, t, g, unknown or other
  misc_feature (275)..(275): n is a, c, g, or t
  modified_base (594)..(594): a, c, t, g, unknown or other
  misc_feature (594)..(594): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggtagtttgggctgagtcttgggttttccttgttgtttattttacaaggtgtccagtgtgaggtgcagctggtggagtcgtggggatacgttggccagccgtgggacggtccctagagtacctctccgtgtcgcacgtcctntgctacttccaccttcgacgtacgaaccaacctaacgtagtcggtacggttcggggtcccgaccggacggtccgtaccgggaagggggaacggggtccgtaggggtacgggttacgggggccggttaccggtaagttaaacgaaagggtaaacgtactaaaacgtacgttaacgaacgtaaacgaaggtaacgtaccgggacgtcggtacgtagggtaaggtaaacggtaacggttaccaacgtacgttacaacgtaaggactaagtacgtaagtaaccaaacgtaactctaacgttgtaacttcacgtaataaaacgntaaaccgacgtaaccgtaacggaaaaccggcggaagtacccggttagttaacgttaatttacggttaggtaggtaaagtaaaaggaaaggtcgttaagggtaggtagggttaggtaggttacgtgttaacggtacg

SEQ ID NO: 145570 - DNA, 864 bp, Homo sapiens
  misc_feature: GYAE6OF01CFKZR.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaangccaccctctcctgcagctccagccagaatatccagacgctactacatacgcctaggtaccagacagaacgcctggccacggcctacccgaggttccctcacgttctacgtcggtccgtaccggggttaccccaacggaccggggacccctaacggttacgggaccctaaccggttacccccgaaggtaacccggttacgggtttacggtaaacgggttcggggtaccggtaaagggggtttccgggggttaccggtacgggggtaacctaacggttacccgtttaccgtaacccttcgttaacccttaacgttaccgttaacgtttacgacgtaacggttaccggtagggtaaccgtaccgtaaggtaacggttaacgtttaccggaccgttaagggttttacgtttaaccttttaacggtacggtttaccgaaggtccgttaaagggtttaacggttagggggtttaaaccgtttccctaaacccgttttcggttaccgggtttccccgggttaaccgggaaaccgggttaaaaccgggaaccggttaaaacggggttaaagtaaaacggttaaaccgggtaaaaccggttaaaccgttgggttaacccgggtaacgttaccggtaaacccctacctttaaacgttcccggttttaaacgg

SEQ ID NO: 145571 - DNA, 661 bp, Homo sapiens
  misc_feature: GYAE6OF01CPBE4.21.4.A04.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggagtttgggctggagcggtgttcgtcgtaggtacgttacgaagtgtcngtgtgagtgcagngtggtggagtcgtgggtagaccgttggcctagccgtaggtacggtccctaggacgacctcgtccttaggcgtccgacncctcgtcactattccgcctacgtgacaccaactacgtagtcggcgtcgggccncgaacggcttaccggaggggacgggnggtaggtaggtcggtacggtacgtaacgtaacgtaacggtaacgtaacgtaacgtaacgtacgtaacgtaacgtaacgtacgtacggtacgtacgtcgtaggtaacggtaacgtaacgtactactacgtacgtacgaagtagtagtacgtaactaacgtaaacgtaactacgtacgtacgtacgtactaacgtaacgtaacgtaacgtaacgaacgtaaccgtaacgtaacgaacgtacgtacgtacgtagttagttagttagtagtaagtaagtaagtaggtagtagtaggtaggtagtgtgtgtacg

SEQ ID NO: 145572 - DNA, 770 bp, Homo sapiens
  misc_feature: GYAE6OF01BJYQW.21.4.A04.1.454.CMB.1.raw
tcagtcgtcgctcgcacgaccggtgctcgatttagagtagtgatcagggggagagctgctcagttaggacccagaggaaccatggaaaccccagcgacacgcttctcttcctcctgctactctggctcccaggctcgagaaccaccggtagtaaagttgtgttgacgcgagtctacgaggccaccctgtctttgcctaccgaaggggtaagcgccacccgtctccggtgacaggtcctaccgagccgaaggtaactacgtaccgagtacgtactactacgaagttaccgtccgttacgggtaacccaggtaccgaaggaacgtccgtacggaccgacggtacccttacccggtaacgggttccctacgtacgttacttaaccggttccggtaccgggtccgggttacccgaggacggggccctaaggtcgggacctaactcccgaagtaccggtaggttacgaggtcggaagtaggttcgggtacgtacggaactacggtacgttccgacgtacctagacgtactagttaccggataacggtacgtcggaacgtcgtaaggtaacgttcgttacgcgtaagtttcgttactttacgtcggtactacggtaacggttagttaacggttacgggttaactccgtacctttcggtcgttacccggtacgggtaaccgtaaacgggtaaaccgttagggtaaaaccgtaaggttaacggaaacggttaccgttgggaccgtccgtacggacctaaccgttgttccggttaccgg

SEQ ID NO: 145573 - DNA, 863 bp, Homo sapiens
  misc_feature: GYAE6OF01EDVOI.21.4.A04.1.454.CMB.1.raw
  modified_base (274)..(274): a, c, t, g, unknown or other
  misc_feature (274)..(274): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcggtgggggatacttggtccagccgtgggacgggtccctaggacgacctctcctgtcgcagccctntcgctattccaccttcgagtacgaaccaacaactgtcggacgtcgggtccaccgaggcctaccggaagggggaacgggtcgtaggggagggttcggggtaccggtaccgttaagttaacggaaagggtaacgtaccgttaaacgtagttaacgaacggtaaacaacggtaaacgttaccgggcgtacggttacgtagggtaagggaaacgggttacggttacccaaccgtaattccgtaacgaaaggtaacgaagttagtaaactttaaccgaaaaacgttaaccttaccgtaaactttacgggttaacttaccgttaacggaaacgttaaaacgttaccggaaaacccgtaccgggtaaacccgttaaaaccgggaaaaaccccgggtacgggtaaccccgtaaacccgggggttacggtttaaacggttttaaacgtttaaagggttttacggggttaaacgggttaaaaccggaaaaccgggttaaaaaaggggttaccggggtttaaggggttaacggttttacggggggttaaggggggttttaaccgggtaaacgggtttccggttaagggtttaaacccggg

SEQ ID NO: 145574 - DNA, 808 bp, Homo sapiens
  misc_feature: GYAE6OF01AZ2EE.21.4.A04.1.454.CMB.1.raw
tcagtcgtcgctcgcacgaccggtgctcgatttagagtagtgatctagggggtaggagcgtggcgtcagtttaggacccagaggggaacccagtacggaaaccccgagccgcacgcttctccttcctcctaggcctactcgtcgccctccgaggcctcgacgaacccacggagaaacttcgtcgtagacgcaacgtcgtccgacggtcgacccttgtcctttaggtcctaccggaacggggtaaaactccgtaccctaaccccgtcttcccgtcgacgaaggtcccgtaccgacggacccgaaagggaacctactaccgaaaggacgtcctaactacataacggtcccgtaggtacccaaggccaaaggaacgtcccgtagggacccagggtcccttaccccgaggtttccctacgattcctaagtcgaccgtcgggtacccacgtacgggcccagtggccaactcccgaagtcgaaggttcgagtcgcgtagtgggtcacgggacacgtacttcgaactctaccgatcacgttaggactacggacgtacggtaaccgtcgtaaggtaaacggttctttaccggcgttaagtttacgttaacggtttctaacgggtcctaaggtaccgtaatttaaccgggagttaaacccgttccgtacccgttacgggttaccgttaccgggttaccggaaaccgttaaacggggtaacccgttaaaggggtaactaaaaggttacccggaaaaacgttcgttacgggtaaccgggtactaccgggaaccttaaaccggttccgttggtttacccg

SEQ ID NO: 145575 - DNA, 635 bp, Homo sapiens
  misc_feature: GYAE6OF01ECOXZ.21.4.A04.1.454.CMB.1.raw
  modified_base (148)..(148): a, c, t, g, unknown or other
  misc_feature (148)..(148): n is a, c, g, or t
  modified_base (168)..(168): a, c, t, g, unknown or other
  misc_feature (168)..(168): n is a, c, g, or t
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaaattgtgttgacgcagtcnccaggcaccctgtctttgctcgaggggaancgcccaccctctcctgcagcctccagccaagaactatcccagacgctaactacatacgcctggaccagcagagcctggccagcctccgagttccncactcgtatcgcgtcgggcccacggacggccacgtcggcctacgtcccaggtacgtaggttacaggtcggacgtagggtcgggtcgtgggactacgtaccttcgaaccttctactatctaagttacgcgtaagtcgtaggacgtaccgtagtaacgttacttcgagtagttgttacttacgtgtacgagtcgtaaggtagttacgggtaacgtttccgtaccgttcgttacggtccgttaccggaaccgtaaacgggtaaccgtaaagggtaaacgtaaggtaacggtaaacgtacggttaggttaccggtacttacggaccttaacgtcgttccgttaccg

SEQ ID NO: 145576 - DNA, 730 bp, Homo sapiens
  misc_feature: GYAE6OF01AYNV4.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcacctgtctttgtctccgagggaagacgccacctctcctgcagcctccgagaccagaactactccgaagacgcctaactacagtacgcctaggtaccagacaacgaacgccgtaggccacggcctcccgaggttccctacacgtctagtcggtccgtcgggtacccacggacgggcctaacgtcggaccacgtacccgagtacgtacggttcaggtcggacgtagggtgggttacgtaggggaaccacggtacctttcgaccttctacgtactactagttacgcgtaacggtacgtacgggtaacgtccgtaaggtaaacgttacgtttaccggaacgttaaggtttacgttaacgtttacgttacgtaccgtaaggtacgtaagggttaacgtaaggggttaaacctttaccgtacccgtttcggttcggttaaccgggttaccggtaaccgggtaaaccgggtaacgtaaacggggttaacgtaaacggttaacggtaaaacggtacgttaggttaccgggtacttacgggaaccctacgttcgttcggtttaccg

SEQ ID NO: 145577 - DNA, 618 bp, Homo sapiens
  misc_feature: GYAE6OF01BC2TM.21.4.A04.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaangccaccctctcctgcagctccagccagaatatccagagctactacatagcctggtaccagcagagcctggccaggcctcccgaggttccncatctatcgcgtcgggcccacgacgggccacgtcgggcacgtcccagactaggttcaggtcggctagggtcgggtctaggggactaggtaccttcactctcatctattacgcagtacgtggacgtccgtagaacgtcgtttacgactagttagtacttacgtcgtacagtactaaggttagtacgggtaacttccgtaaccgttcgtcggttaccggttaccggaaccggtaaacggggtaacccgtaaagggtaaacgtaaacggttaacgggtaaaaccgtaacggttaggtacggtacgtacggaccaaccttacgttcgttaccg

SEQ ID NO: 145578 - DNA, 566 bp, Homo sapiens
  misc_feature: GYAE6OF01CL4ML.21.4.A04.1.454.CMB.1.raw
  modified_base (558)..(558): a, c, t, g, unknown or other
  misc_feature (558)..(558): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttttcttgttgttattttacaaggtgtccagtgtgaggtgcagctgggtggagtcgtgggggagacttggtccagcctggagggtccctgagactctcctgtgcagcctctgcattcaccttcagtcgaccacaacatcggactgggtcccgccaggctaccgaggggaacgggctgggagtggggtcggccgtattacgaaaggaagactaacagttacagtacaagaagtacggcgcgtctggtagaaaggaacggttacaccagtactacgaaagagatagaattacaaaagtaactcgaactgtaatctagactaaatagaacagtacctaagaaaccgaaggacaccggcgtagtattagttgaggtaagaacaaaaggagtagggatggtagtggtagngtggtacg

SEQ ID NO: 145579 - DNA, 585 bp, Homo sapiens
  misc_feature: GYAE6OF01DV69M.21.4.A04.1.454.CMB.1.raw
  modified_base (219)..(219): a, c, t, g, unknown or other
  misc_feature (219)..(219): n is a, c, g, or t
  modified_base (316)..(316): a, c, t, g, unknown or other
  misc_feature (316)..(316): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatgggagtttgggctgagcttgggttttccttgttgttattttacaaggtgtccagtgtgaggtgcagctggtggagtcgtggggganacgttgggtccagcctgggagggtcccctgacgactctcctgtgcagccctctgccattccaccttcagtcgaccaacaacagtggactggggtccnccaggcctccgagggacgggctggaggtggtcgcgtatacgaaggaanctaaangttacagtacagaactcggcgcgtntggtagaaagggtaagttcaccatcacaagngaatgacttanaaagactacatgtaatcaganaaagtcgaaacncgtacctaaggaaaccgacgaccgaccgggtaccttaggttactttaggtggtaacggtaagaaacgtaaaaggaggttggaacgttggttagggtaggtacgtcgtggtaacgg

SEQ ID NO: 145580 - DNA, 702 bp, Homo sapiens
  misc_feature: GYAE6OF01D5HLN.21.4.A04.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccacctctcctgcagctccagccagaatatccagagctactacatacgcctggtaccagcagaacgcctgcaggctccgaggttccncatctagtcgcgtcgggtcccacggacgggaccacgtcggacacgtcccgaagaccgtacggttcaggtcggacgtagggttcggggtctacggggaacacggttaccttcaccgttcgtactattaccgtaagtttacgacgtaacggtacgttagggaacgtaccgttaaggaacgttacgtttccggactaacggtttagtttaacgtttacgttcggttacgaacggtaccgtaaggttaacggttacgggttaaacgtttacccgtaacccgtttcggttaccgggtttaccggttacccgggaacccggtaaacggggtaaaccgttaaacgggtaaacgtaaacgttaacggaaaaaccggtacgttaggtacggtaccgtacgtacccgtaacttagttccgttacg

SEQ ID NO: 145581 - DNA, 814 bp, Homo sapiens
  misc_feature: GYAE6OF01BZT6U.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagtcgttgggttttccttgttgttattttacaaggtgtccagtgtgaggtgcagcgtggtggagtcggtggggagtacgttggtccgagccgtgggacggtccctaggacgtacctcctccgtgtcgcacgtcctctgtctacttcctaccttacgacgtaccgaaccaactaacgtagtacggtacggtccggtcccgaccgacggtccgtaccgggaaggggaacggtcggtacgggtagggtcgggtaccggtaaccgttaagttaaccggaaaaggtaacgaaccttaaaggtaacgttaacgaacgtaacgaaagtaacggtacccggtcgtacggttacggtaaggtaacgggtaaacggtaaccggttacccaacgttacgtaaccgtaagtaaacgtagtaacgtaaggtaactaacgtaaaacgtaccttacgtaccgttagtaactacgtaactaacgtaacgaacgtaaccgtaacgtaaccccgtaaaacggaaaacccggtaccgggaaccgtaaccgggttacccgtttaaggttaacgttttaacggtagggtaaccggttaaaaggaaaccggttaaaaggtaaggggttaccgttaaagggtttggggtaaaggggtttagggtaaaccgttggttaacgggttaaacccggg

SEQ ID NO: 145582 - DNA, 663 bp, Homo sapiens
  misc_feature: GYAE6OF01DZ1WP.21.4.A04.1.454.CMB.1.raw
  modified_base (268)..(268): a, c, t, g, unknown or other
  misc_feature (268)..(268): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccaggcctgggagggtcccctggacgactctcctgtgcagcctntgcattccaccttcagtcgaaccacaacagtggactcggggtcccgccgaggcctccgaggggaacggggctagggaggtgggtccggacgtagttaacgaaggaacgctaaanagttacagtaacagaatcggcgtcgtctggtaaggaaaggtacggttacacctatctacgaagagtatagaattacgaaaagtaactactaacgttagtaactcgtagaacctaaaagtacgaaaaccgtagtacccgtaaacggaaaaacccgggaggacccgtaaccgggtccgttaaggttaacgtttaacgttagggttacgggtaaagaaaccgtaaaaaagggtacgggttaagggaagtttcgggttacggggtaggtaagccgttgggtaacg

SEQ ID NO: 145583 - DNA, 847 bp, Homo sapiens
  misc_feature: GYAE6OF01C2G5F.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccaccggagaaattgtgttgacgcagtctcaggcacctgtcttgctcgagggaancgccacctctcctgcagcctaccagccaagaatacaccagacactactacagtacgcctggtaaccagcaagaacgctacggccaggtcctacccgaggttccctactacttacgtagtcggtccgttcggggtacccaacggacggggccctaacggttcggaccaccgtacccgaaggtaaccggttacggtttccgaagggttcgggtacgtaggggtttcggggttacgtacgggggactaacggttaccctttacgaccgttcgtactaacgttaccgtaacgtttacgggaccgtaaggtaaccggtaggggtaaaccggtaccgtttaaagggaaacggtttaccgttttaccgggacgtttaacgggttacgttttaaccgtttacggttacgtaaccgttaagggtaccttaaagggtttaccggttacggggttaaaccctttcccgtaaccgtttacccggtttacggggttaccccgggtttaccggggaaacccggttaaaaccggggggtaaacccgttaaacggggggttaaaacggtaaaacgttaaacccgggtaaaaccggtaacgggtttacggtaccggggttaacctaaaccggttacccggaaacctttcggtttacccggtttaaccgg

SEQ ID NO: 145584 - DNA, 678 bp, Homo sapiens
  misc_feature: GYAE6OF01AT9DS.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgctcgagggaancgccaccctctcctgcagctccagccaagaatactccagacgctactacatacgcctggtaccagcaagacgcctggccaggcctccccgaggttccctcgatctagtcgtccgtcgggtcccagacgggtccacgtcggcacgtcccgaagtacgtacggttcagggtcggacgtagggtcgggtcgtaggggaactacggtacctttcgaaccttcttacattctaagttacgacgtaaggtacgtcgggaacgtccgttaaggtaacgttacgtttcggacgttacggttagtttaactttacgttgtacgtacgtacgtaaggttacgtacgggttaactttccgtaaccgtttcgtacggttaccggttacccgggaaccggtaaaacgggaaccgtaaagggtaaacgtaaacgtacggtaaaaccgttaacggttaggtacggtacgtacgaaccgttaacgtacgttcggttacg

SEQ ID NO: 145585 - DNA, 791 bp, Homo sapiens
  misc_feature: GYAE6OF01AWQZ7.21.4.A04.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacgttggtccagccgtgggacgggtccctgagactctcctgtgcagcctctgcattcaccttcagtgaccacaacatcggactgggtcccgaccgaggcctaccggaagggggaacggggcgtggggaggtcggggtccgggccgttaagttaaccgaaagggaaacgaccttaaacgacggttaacaaggttaaccaaggtaacgtaccgggcgtacggttcgtaggtaggaaaacggggtaacggtttaccaacccgtagttacctaacgaaaaggtaagaagttaggtaaactttaacgaaaaacggtaaaccttaccgtaaccgttagttaacctcgtacgtaactaaaacgttaacggaaacctaaccgggtaacccgttaaacggaaaaaacccgggtacgggaaacccgtaacccggggttacccggtttaggtttaaacgtttaaggtttacggggttaaacggggttaaacgaaaacccggtaaaaaagggtacggttaacggggtaacggtttaggggtttaggggttaaaggggttaaggtccggttaagggttaaacccggg

SEQ ID NO: 145586 - DNA, 694 bp, Homo sapiens
  misc_feature: GYAE6OF01DXK0I.21.4.A04.1.454.CMB.1.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagctggtggagtctggggganactttggtccagcctgggagggtccctggagacctctccgtgtgcagccctntgctattcaccgttcagtcaccacaacatggactgggtccgccaggcctccgagggacggggctgggagtgggtccggacgtagttaaccgaaggaacgaccttaaaacggatttaaccgaagttaacaagaacgtacgggcgcgttacgtggtaggaaaacggtaggttccaacctacgtctacgaaagagaattagaatttacaaaacggaaccttcgtaaactgttactcgttaacggactaaaatcggaaactaccggtacccgttaaaggaaaaaccccgggagggaacccgaaccggggtacccgttaaggttattttaacggttggttaaacgggttaaagaaaaccggtaaaaaggtcgggtttaaagggaagtttaggggttacggggttagggttaacggtcgttgggttaaacccgg

SEQ ID NO: 145587 - DNA, 760 bp, Homo sapiens
  misc_feature: GYAE6OF01CA9G9.21.4.A04.1.454.CMB.1.raw
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctccaggctcaacgaaaccacggagaaattgtgttgacgcagtctccaggccaccctgttctttgtctaccgaaggggaaacncgccctaccctctccgtgccacgcctaccagccaagaactacnccgagacgtctactacatacgccgtacggtaccagacgaaggaacgtccgtcggaccgacggtccctaccccgtacggtttccctacgtacttccgttagtcggtccgttaccggggtacccaacggtaccgggaccctacggtcggacctaccgtaccccgaggtaccgtacggttacgagggtcggcgtagggttcgggtcggtagggacctacgtaccttaccgacttacgtactacgttacgtaacgttacgcgtaacggtacggtacgggtacgttaccgtaaggtaacgttacgtttaccggtacgttaaggttacgtttaacgttacgttacggttaccgtacggtacgttaaggttacggttacggttaaccgtttaccgtaccgttcggtttccggtaccggttaccggaacggtaacgggtaaccggtaaaggtaaacgtaaacgtaacggtaaaccggtagttaggtacgtacgtacgaaccgtactcgttcgttaccg

SEQ ID NO: 145588 - DNA, 761 bp, Homo sapiens
  misc_feature: GYAE6OF01EJ9BG.21.4.A04.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagagtagtgatcaggggagagctgctcagttaggacccagagggaaccatacggaaaccccagcgcagcttctcttcctcctgctactctggcctcccaggctcaagaaaccaccggagtaaattgtgttgacgcagtctccgaggcctaccctgttctttgtctccgaaggggaancgcccaccctctccgtgcacgcctccgacgccgaagtaactactacccgaagacgtaccttaactaaccaagttacggtacccgttacgggtaacccaggaccaacggaaaccgtcccggttacgggacccgtaacgggtccccttaccccggtaacgggttttcccctactaacgtttaccgttaaggttccggacccggtttaccgggggtaacccccaacgggaccggggtaccctaacgttccgggacctaaccgtacccgaacggtacgttacggttacgagggtcggacgtaggggttcgggtacggtaggactacgtactttaccacgttctactacttactaagttacgacgtaaggtacgtaggacgtacgtagtaacgttcttacgacgttagttagttacttcgtagacgtagtacgtaagtagtacgtacgttcctacgtcgttacggttacggtacgaaccggaacgggtaactaaaggtaacgtaacggttaacggaaacgttacgtggtacgtacgtaccatacctgtccgttacg

SEQ ID NO: 145589 - DNA, 784 bp, Homo sapiens
  misc_feature: GYAE6OF01DG0DG.21.4.A04.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaccaccgagaaattgtgttgacgcagtctccaggcaccctgtctttcgtctccgaaggggaaagcgccaccctcncctgcagcctccagccaagaactactccaagacgctaactacatacgacctggtacccagcaagaacgcctggccacggcctcccgtaggtttccctacgtacttctacgtggtccgttcggggtaccccaacggacgggaccctacgtcgggccctaaccgtcccaacggtaacgtacggtttaccggaggttcggacggtaacggggtttcggggttacggttacgggaaacctacggtaaccttcccacgttcctacgtacgtacctaagtttacgaccgaacggtaccgtagggtacgtaccgttaaggaacgttacgtttacggtaccggttagttacgtttaacgtttaacgtcgttaaccgaagtaccggttaaggttaaggttacggttaaccggtttacccgtaacccgttacggttttaccgggtacccgggtttacccggaaccggttaaaacggggaacccgttaaaacgggttaaacgaaacgttaaacggtaaaaacccggtaacggttaccgggttacggttaccgtaacggtaccgtaaacctcgtttccgttaacg

SEQ ID NO: 145590 - DNA, 713 bp, Homo sapiens
  misc_feature: GYAE6OF01BUNRR.21.4.A04.1.454.CMB.1.raw
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaanactccaccctctcctgcagctccagccagaatactccagagctactanatacgcctggtaaccagacgaagaacgcctacggaccaggtcctacccgtacggttcctcgactctagtcgtcgtcggtacccagacggccacgtcgacctacgtacccgagtaccgtacggttacgacgggtcggacgtacggggttacgggtcggtacggggaaccgtaacggtaccgtttaccgaccgtttaccgtaccgtaacttaaccgtaacggtttaacggaccgtaacggtacgtacgggtaacgtacccggttaaggtaaacggttacgtttccggacgttaacggttacgttacgtttacgtgtacgtaacgtacgtaacgttaggtacgggttaacgtttaccgtaccgttcgtacggttccggttacggacccggtaaacgggtaacgtaagggtaaacggtaagtaacggtaaacgtacggtagtacggtactacgacctactgtcgttacg

SEQ ID NO: 145591 - DNA, 628 bp, Homo sapiens
  misc_feature: GYAE6OF01BQUJ1.21.4.A04.1.454.CMB.1.raw
  modified_base (316)..(316): a, c, t, g, unknown or other
  misc_feature (316)..(316): n is a, c, g, or t
  modified_base (548)..(548): a, c, t, g, unknown or other
  misc_feature (548)..(548): n is a, c, g, or t
  modified_base (621)..(621): a, c, t, g, unknown or other
  misc_feature (621)..(621): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtcccagcctgggacgggtccctggagacctctcctgtgcagcctctgctattccaccttcagtcgaacccacaacatgggacctggggtcccnccgagggcctccggaaggggaacggggctgggaggtggggtccgaccgttaataacgaaaggaaagctaaacagttacaagtacaaggaactacgggcgtcgtcgtaggtaggaaacgggtacgttaccaacctatacctacgaaagtaagtatagtaacttaccgaaaagtaacctcaacgttgtactactagaactaaatcgaaacgtacgaaccgtaaggaaaacccgngaaccgaccgtcgtagttacttagttaggtagtaagaacgaaaggagtgggtaagtgggttagggagtacggntggtacg

SEQ ID NO: 145592 - DNA, 667 bp, Homo sapiens
  misc_feature: GYAE6OF01AIV2G.21.4.A04.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (320)..(320): a, c, t, g, unknown or other
  misc_feature (320)..(320): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagcctccagccagaatacnccagagctactacatacgcctggtaccagcagaacgcctggccaggcctcccgaggttccctcatctatgctcgggtcccacgngggcccacgtcggccacgtcccgagtaccgtacggttccagtcggcgtaggttcgggtctcgggaacacgtaccttcgaccttcgtacctagtctacgttacgacgtacgtacggtacggacgtccggtagtaaggttacgttccgacgtagttacgttaacgtttacgtcggtacgtacgtacgtaaggttacggtaggttaaccgttacctaccgtttcgttcggttacccgggttaccggaacggtaaacgggtaaccggtaacgggttaaacgtaaacggttacggtaaaacggtcttagggttaacgtccgtacgacccgtacttacgttccggtttaccgg

SEQ ID NO: 145593 - DNA, 631 bp, Homo sapiens
  misc_feature: GYAE6OF01BM8ZV.21.4.A04.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagtcgtcgctcgcacgaccggtgctcgatttagagtagtgatcaggggagagctgctcagttaggacccagagggaaccatcggaaaccccagcgcagcttctcttcctcctgctactctggctcccaggctcagaaaccaccggagaaattgtgttgacgcagtctccaggcaccctgtctttgtctccgaggggaaancgccaccctctcctgccagctcagccagaatntccagagctacacatacgctggtaccagcagaacgccgtggaccaggcctcccgtaggttccctcacgtctatcgccgtgggtacccagacggccacgtggcactcccagcgtaggttcaggtggcctaggtcgggctgggacagacttcacttcgtacattctagttacgacctagtaccgttagggacgtccgtaggtaacgttacgtttcggactagttcgttaattacgtgtacgacgtacgtaaggttagtacgggtaacgttccgtaccgttcgtcggttacccggttacggaccggtaaacgggtacccgtaaagggttaaccgtaaagttaacgggaaaccgtacgttcggtacggtacccgtacgaccctacgttacgtccgttaccg

SEQ ID NO: 145594 - DNA, 647 bp, Homo sapiens
  misc_feature: GYAE6OF01A01V7.21.4.A04.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagctccagccagaatactccagagctactacatacgcctggtaccagcagagcctggccaggcctcccgaggttccncatctatcgcgtcgggtacccagacgggccacgtcggacactcccgagtaccgtaggtttccagggttcggacgtagggttcggggtacctagggggaaccaacggttacctttcgaccttaccgtactaattctaagtttacgactaacggtacgtagggaacgtccgttaaggtaaagttacgtttccgacgttaagttcgtttaatttacgtagtacagtacgtaagttataggtaacttccacgttacgtgtccggttacggaccgtaaacgggtaaccgtaaagggtaacgtaaagtacggaaaacggtacgtaggtacggtccttacgaacctacgtagttcgttacg

SEQ ID NO: 145595 - DNA, 732 bp, Homo sapiens
  misc_feature: GYAE6OF01EKHPV.21.4.A04.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtagtatttacaagtgtcagtgtgaggtgcagcgtggtggagtcgtggggganacgttggtccagccgtggacggtccctgacgactcctcctgtgcagtcctctgctattccaccttcagtcgaaccacaactagtcggacgtcgggtcccgaccgtaggcctaccggaaggggtaacgggtcgtgggaggtcgggtaccggccgtaaagttaacgaaaggaaacgtacgtaaaacgtagttaacgaagtaaccgaaggtaacgtccgggcgtacgtcgtaggtaacggaaaaggtacgttaccaaccgtaatcctaagaacggagtagtaagtaacttaacgaaaacgtacctacgtacgttacgtattacgtagtaactaaacgtacgaaaccgtacgtaacccgttaaacgggaaaacccgaggggtaacccgtaaccggggttaaccgtttaaggtttaaccggttaaaggttttacgggtaacgggttaaaacgaaacggtaaaaacgggtaggtttaacgggagtttaggggttacgggtaaggttacggttaccgtggtaacccgg

SEQ ID NO: 145596 - DNA, 751 bp, Homo sapiens
  misc_feature: GYAE6OF01EXIG6.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagtacttggtccaggccgtgggacgggtccctagacgactcctcctgtgcacgtcctctgcattccaccttcagtacaaccaacaacgtagtggaccggtcgggtcccgaccgaggccgtaccggaaggggacggggtcgtggggaggtcggggtaccggtaccggttaagtaacggaaaaggtaaacgtacgtaaactaacggttaacgaacgttaacgaaggtaacgtaccgggaccggtcgttacgtaggttaaggaaacgggtagttacccaactatactacgaagtaagaatgtaaacttacgaaaagtacctactaacgttgtaacgtcgtaagaactaaacgtaagtaaacccgaacggtaacccgtaaacggaaaaacccggtaggtaacccggaaaccgggttccgttaaaggtttaaacttttaacgggttaggggtaaacggttaaaagggaaaacgtaaaaaggggtgggttaaggtaacggttaggggttaggggttaggttaaacgggtgttagggtaaccg

SEQ ID NO: 145597 - DNA, 749 bp, Homo sapiens
  misc_feature: GYAE6OF01EN9BS.21.4.A04.1.454.CMB.1.raw
  modified_base (732)..(732): a, c, t, g, unknown or other
  misc_feature (732)..(732): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggaggtttgggctgagtcttgggtttttccttgttgtttattttacaaggtgtccagtgtgaggtgcagctggtggaggtcgtgggggatacgttggtccacgccgtgggacgggtccctgacgactctccgtgtgccagcctcgtgcctattccaccttcagtacgaaccacaacagtcggacgtcggggtacccgccgacgggtccgtacccgggaagggggtaacggggcgtaggggagggttcggggttccgggaccggtttaagttaaccggaaaagggtaaacgtaccgtaaacgtaaggttacgaacggtaaccaaggtaacgtaccgggccgtcgtacgtaggtaaggaaagggtaacgttaccaaccgtagtaccgtaacgaaggaagaattaggtaacttaacgtaaaacggtaacctactaacgttagttaaccttacgtaaggtaacaaaacgttagaaaccgtacggtaaccgtaaaccggaaaaccgacggtaaccgaccgggtacgttagtttaacgttaagttcgggttaagggtaacgtaaacgtaaaagggtacgtagggtaggttaggttagggttagggngttccgggtgtaaccgg

SEQ ID NO: 145598 - DNA, 768 bp, Homo sapiens
  misc_feature: GYAE6OF01CVY8I.21.4.A04.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggccaccctgtctttgtctccgaggggaaancgccaccctctcctgcagctccagccaagaatactccagacgctaactacatacgcctaggtaccagcagaacgcctggccaggcctccgaggttcccnactctatcgcgtcgggtacccacgacgggcctacgtcggctaactcccgaagacgtacggtttcgaaggttcggcgtagggttcggggttaccgtagggggaactacggtacctttacgaccgtttcctacgtaacttaccgtaagtttaacggactaacgggtaccgtagggtaacgtaccgtaaggtaaacgttacgtttccggacgttaacgggttacgtttaacgttttacgtcggttaccgtaacggtacgttaaggttacggttaagggttaaaccgtttacccgtacccgtttacggtttcgggttaacccgggtttaccgggaaacccggtaaacggggtaaacccggtaaaaggggtaaacggtaaaaggttaaccggtaaaaacgggttaccgtttagggtaccgggtaaccgttacggtaaccctaaacccggtagtttcccggtttaaaccggg

SEQ ID NO: 145599 - DNA, 697 bp, Homo sapiens
  misc_feature: GYAE6OF01DSPU1.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgttcttgtctccgaggggaancgccaccctctcctgcagcctccagccagaatactccagacgctactacatacgcctaggtaccagcaagaacgtccgtaggccacggcctaccccgtaggttcccacattccttatcgccgtcgggtacccacgacgggccacgtcggaccactaccgagaccgtaggttccaggtcggacgtaggtggggtcctagggaactacggtacctcgtacctctactattactaagttacgcgtaacgtaccggtagggtaaccgtccgttaggtaaacgttacgtttaccggacgttaagggttattaacgttcgttaggtcaacggtacgtaacggttagtacgggttaaaccgttccgtaaccgttcggttaccggtacggttacccggaaccggtaaacggggtaacgtaaacgggtaaggtaaagttaaccggtaaaacgtaccgggttaggtaccggtacgtaccgaaccgtaactacggttcgtttacccg

SEQ ID NO: 145600 - DNA, 650 bp, Homo sapiens
  misc_feature: GYAE6OF01DSKPD.21.4.A04.1.454.CMB.1.raw
  modified_base (622)..(622): a, c, t, g, unknown or other
  misc_feature (622)..(622): n is a, c, g, or t
  modified_base (643)..(643): a, c, t, g, unknown or other
  misc_feature (643)..(643): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggaggtccctgagactctcctgtgcagcctctgctattccaccttcagtgaacccacaacagtcggactggggtcccgccgaggcctaccggagggggaacggggcgtagggaggttcggggtccggacccgttaattaaccgaaagggaaacgtccgttaaaacgaggtttaacaacggttaaaccgaaggtaaacgtaccggggcgtcggttacgtaggtaagggaaaaggggtaacgggtttaccaacccgtacttcgtaacaaaggagtaataggtaattacaaaagtaactcaacgttgtactcgagaactaaagtcgaaacagtaccctaaggaaaacccgaggaccgacgggtcctagtatttagtggttagaagaacgaaagngtggacgtggtggtaggtagngtgtacg

SEQ ID NO: 145601 - DNA, 608 bp, Homo sapiens
  misc_feature: GYAE6OF01BCNAY.21.4.A04.1.454.CMB.1.raw
  modified_base (200)..(200): a, c, t, g, unknown or other
  misc_feature (200)..(200): n is a, c, g, or t
  modified_base (372)..(372): a, c, t, g, unknown or other
  misc_feature (372)..(372): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctcgggtcccacgacgggcccacgtggaccacgttccccaaggaccgtaggtttcagtcgggacaggtcgggtcnggggacacgctttcacctctcatcattagcagacgtggacgtcctagaagtatttccgctaggtgttaactttacgtgttcaggctaaggttagtacgggtaagtttacctaccgttcgttcggttaccggtttccgggacccgaaaggggtaacccgtaaaggggttaagaaacgttacgggaaaaccgtaacgttcggtacggtccgttacgccgtaaccctgttccgttacgg

SEQ ID NO: 145602 - DNA, 727 bp, Homo sapiens
  misc_feature: GYAE6OF01BLNX0.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaagcgcccacctctcctgcagcctccagccaagaactactccagagtctactacatacgcctaggtaccagcagacgcctggccaggcctccgaggttcctacatctagtcgccgttacggggtaccccacggacgggccacgtcggacctactcccgaagaccgtaggttcaggtcggacgtagggtcgggtacgtcggggacacgtaccttacaccttctacaacttaccgtaagtttacgacgtacggtacgtaggggaacgtccgttaaggaaaccggtttctttacggacgttacggtttagtttacgtttaccggtgtacgtacgtaacgttaggttaggttaaccgggttaacgtttaccgttacccgtttacgggttaccgggttacccggttaccgggaaaccgggtaacgggtaaaacccggtaaacggggttaaacgtaaaacgggttaacgggtaaaaccggttacggttggtaaccgggtccttacggaacccgttacttaaccgtttcgttaccgg

SEQ ID NO: 145603 - DNA, 840 bp, Homo sapiens
  misc_feature: GYAE6OF01DUVPD.21.4.A04.1.454.CMB.1.raw
  modified_base (192)..(192): a, c, t, g, unknown or other
  misc_feature (192)..(192): n is a, c, g, or t
  modified_base (304)..(304): a, c, t, g, unknown or other
  misc_feature (304)..(304): n is a, c, g, or t
tcagtcgtcgctcgcacgaccggtgctcgatttagagtagtgatcaggggagagctgctcagttaggacccacgaggaccatggaaaccccagcgcagcttctcttcctcctgctactctggctccaggctcagaaaccacggagaaattgtgttgacgcagtctccagcacctgtctttgctcgagggaangccacctcgtcctgcagctccagccaagaatatccgagagctacgtacataacgctggtaccagaccaagaacgcctcggccacggctaccccgtaggtttcctactaactntaacgttcgccgtacgggtacccacgacgggacctaacgtggcctaacgtccccaagaccgtacgggtttaccgaggttacgggaccgtaagggtttcggggtacgttacgggggtaaccaacgggttaccttttaccgaaaccgtttccgttaaccgtaacgttaacccttaaagtttaaccggggtaaaccaacgggtaaccgtttacgggggaactacccggttaaaaggtaacgtttaaccgttttccgggaccttaagggtttaccgttaacggttttaaacctcgggttttaaacccgaagggttaaccgttaaacgggttaaagtttaacgggggttaaacccgtttttaccgtaaccccgtttcggtttacccgggtttaaccggttttaaccccggggaaaccggttaaaacgggggtaaaacccgtaaaacggggttaaaaccggtaaaagtttaaccggtaaaagttaaacggtaacgttaacgggtacggtacgtacggttaaccccaacgggttcttaacccg

SEQ ID NO: 145604 - DNA, 719 bp, Homo sapiens
  misc_feature: GYAE6OF01E4X3J.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaagacgccaccctctcctgcacgcctccagccaagaactactaccagacgctactacatacgcctaggtaccagacagaacgccgtcggccgacggtcctccccgtaggtttcccactacgtcttagtcggccggttccggggtacccacggacggggaccctacggttacggacctaaccgttaccccgaaggtaccgttacgggttaccgagggttcgggacgtaggggtttcggggtaccgtacggggactaacgtacctttaccacttcctacgtacttactaacgttacgacgtaacgtacgtcgggtacgtccgtaggtaacgttacgtttacgacgttaggtttacgttacttacgtcgtaccaggtcgtaaggttacggttacggtaacgtttccgtaccttacggttcggttaccggttaccggaccgtaaacgggaaccgtaaagggtaacgtaaagtaacggaaaccgtagttacggtacggtacgtacgaaccgaccttagttcgttacg

SEQ ID NO: 145605 - DNA, 832 bp, Homo sapiens
  misc_feature: GYAE6OF01C1BUB.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaacccagcgcagcttctcttcctcctgctactctggcctcccaggctcaagaaaccaccggagtaaattgtgttgacgcagtctccaggccacctgtctttgctcgaagggaancgccaccctctcctgcacgcctaccgacgaccaagtaactacgtaccaggacaccttaactacaacgttacgcccgttacggtaaccaggacaaaggaacgcccgtagggacccgacggtcccttaccccggacggttttaccctacgtaacgttaccgttacgtccggtcccggttaccgggtacccaaccggtacggggaccctacggtcggacctaccgtacccgaaggaccgtacggttcgaacggtcgggacgtacggggttcgggtaccggttacgggaaccttacggttaccgtttacctaacccgtttaccgtaccgttaaccgttagtaaaccgtttacggaccgttaacggtaacggtacgggtaccgttaacgtaagggttaacgtcgtttacggtacgtagtttacttaacgttactacggtagaacgttacggtaagttaggttaaccgggttaacgttcccgtacgtttacggttacggttaccgggttaccggaaaccggtaaacggggtaaaccgttaaagggtaaaccgtaaaggttaaacgggtaaaaccggttacgggttgggttaaccggtacaacccgggttaacctaacggttcgtttaccgttacccg

SEQ ID NO: 145606 - DNA, 733 bp, Homo sapiens
  misc_feature: GYAE6OF01A24IQ.21.4.A04.1.454.CMB.1.raw
tcagtcgtcgctcgcacgaccggtgctcgatttagagtagtgatcaggggagctctgagagcggagccccagccccagaattcccaggttgttttcatttggtgatcagcactgaacacagaggactcaccatggaggtttgggctgagtcgttgggttttccttgttgttattttacgaggtgtccagtgtggaggtgcagtcgtgggtggagtcggtgggggagtacgttggtccaggtccgtgggacgggtccctggacgtacctcctccgtgtcgcgacgtcctctcgtctacttcctaccttacgtacgtacgaaccaacaacggggggggggtactcggtacgtccgggtcccgccgacggccgtaccggaggggaacgggtcggtgggtacgggtcggggtaccgggtaccggttaacgtaacggaaacggtaaacgtaaccgtaaacgtaacgttaacgaacgtaacgtaacggtaacgtacggtcgtacggtcgtaggtaaggtaaacgggtaacggttaccaaccgtactacgtacgaagaagtagtagtaactaacgtaaacgtaactactacgtagtactactagtaactaaagtaacgaacgtaacgtaaccgtaaacgaaaccggaacggaaccgtaccggtacgttacgttagttagttaggtaggtaagaaacgtaaagaaggtaggtagtggttagggttaggtaggtgtggtacg

SEQ ID NO: 145607 - DNA, 679 bp, Homo sapiens
  misc_feature: GYAE6OF01BFM54.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagacgttggtccagccgtgggacgggtccctggacgtactctcctgtgcagcctctgctattccaaccttcagtacgaccaacaacagtggacgtcgggtccgccgaggcctaccggaaggggacggggcgtgggaggtcggggtcggaccgtaagtaacgaaaggaaagctaaacagttaacagtaacaaggtaacgtacggcgacgtcgtaggtaggaaaagggtacggttaccaacctagtacgtacaaaggacgtataagtaacttaacgaaaaggtaaccttacgtaacgttagtaacttcgtacgaactaaagacgtaaaaccgacgtaacccgttaaaggaaaacccggtaacggtaaccgaaccgggtaccgttaagtacgtttaagttagggtaacggtaaagaaacgtaaaaggaggtaggtagttgggtaggtaggtaggcgttaggtaacg

SEQ ID NO: 145608 - DNA, 719 bp, Homo sapiens
  misc_feature: GYAE6OF01B3QCY.21.4.A04.1.454.CMB.1.raw
  modified_base (199)..(199): a, c, t, g, unknown or other
  misc_feature (199)..(199): n is a, c, g, or t
  modified_base (303)..(303): a, c, t, g, unknown or other
  misc_feature (303)..(303): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgctccgaggggaaancgccaccctctcctgcagcctccagccaagaatactccagacgctactacatacgcctaggtaccagacaagaacgccgtggccaggcctacccgtaggttccnctatctagtcgccgtcgggtacccacggacgggcctacgtcggaccactacccgagaccgtaggttcaaggttcgggacgtaggggttcgggtcgtacggggaactacggtaccttcgaccttcgtactacttacgtagttacggcgtaacggtacggtacggaacgtccggtaagtaacgttacgtttccggacttaggttagtttaacgtttacgttaggtaccgtaggtaccgttaaggttacggttacgggttaacgtttcctaccgttcggttaccggttccggttaaccgggaaccggtaaacgggtaaaccgtaaagggttaaacggtaaaacgttaacgggtaaaacgttacggttacgggttaccggtaccgttacgaaaccccttacgttacgttccgtttaccgg

SEQ ID NO: 145609 - DNA, 658 bp, Homo sapiens
  misc_feature: GYAE6OF01EM38B.21.4.A04.1.454.CMB.1.raw
  modified_base (274)..(274): a, c, t, g, unknown or other
  misc_feature (274)..(274): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtcagtgtgaggtgcagctggtggagtcgtgggggatacgttggtccaggccgtggggacgggtcccctggacgacctcctccgtgtgcagccctntgcctattccacctttgagtcgaacccacaaacagtgggaccgtcggggtcccgccgaggcctaccggagggggaacggggtcgtacggggaggttcggggtccgggtaccggttaagttaaccggaaagggaaactacgtaaacgtagttaacgagtaaccaagtaacgtacgggcgtacgtcgtagtaaggaaacgggtacgtaccaaccatactaacgaagagtatagtaactacgaaagtaactctaactgtactctacgactaagacgaacacgacctaacggaaacgacggaccgaccggtaccgttagttagttagttaggtagggtaagaagaaaacggtggtaggtagtaggttagggtagtacgtgtaggtacg

SEQ ID NO: 145610 - DNA, 844 bp, Homo sapiens
  misc_feature: GYAE6OF01BUPQA.21.4.A04.1.454.CMB.1.raw
  modified_base (217)..(217): a, c, t, g, unknown or other
  misc_feature (217)..(217): n is a, c, g, or t
  modified_base (318)..(318): a, c, t, g, unknown or other
  misc_feature (318)..(318): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagccgtggacgggtccctgacgactctcctgtgcagcctctgctattccaccttcagtcgaacccacaactagtcggaccgtcggggtcccnccgacggccgtaccggagggggaacggggccgttaggggaggttcgggggtccggtaccggtttaaagttaaccggaaaagggtaaacgtaccgttaaaacgtaacggtttaaaccgaacggttaaaccaaacggtaaacgtaccggggaccgtccggttacgttagggtaacgggtaaaacggggtaacggtttacccaacccgttaattaccgtaaaccgaaacggtaagtaacgtacggtaaacctttaacgaaaaacggtaacccttacccgtaaacgtttacggttaacttccgtaacggaaacttaaaacggtaacgaaaaccgtaacccggtaacccgtaaaacgggaaaaacccgggtacgggaacccgtaaccgggttacccgttaagggtttaaacctttaggtttacgggttaacggggttaaaacgaaaccgggtaaaaaagggttaggttaaggggtaacgtttagggggttacgggtttaagggttaacggttcgttaggggttaaacccgg

SEQ ID NO: 145611 - DNA, 779 bp, Homo sapiens
  misc_feature: GYAE6OF01BV3HP.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctacctgtcgcctaccgagctacgaacgaacccgacggaataagttggttgtacgacgacgtacgtccctacgacgcccctaccgttcgtttcgtttccgtccgaaccggggaaaaggggaaacgcccgtaccccctacccttccgttaccgcgacgacgtccctaccgaccgacgtaataactaccgaaccggagtactacctaactactagtaccgtacggttaccggaacagacgaaggacccgtcggaccgaccgaccggtccccttacggttaccttccatacttcgtacggtccgttccgggtacccggtaacccaaggggtcccgtacctacgtcggaccctacccgtaaccggacgtaacggttgtaaccgtgggtccgacggttaggggtccgggttaacgacggtaataccgttcttacctacgtacctagtactacgtacgtaccgagtaccggtaggtagtaccgtgtaagtaacgtttccgtacgtagttacgttattacgttacggtctaagagtaacgtaagttaggttacgttacctaccgttccgttaggttcccggttacggaacccggtaaggtaacccggtaaaggtaagtaaagtacggaaacggtacgtggtacgagtccacgacctacgtcgttcgttacc

SEQ ID NO: 145612 - DNA, 826 bp, Homo sapiens
  misc_feature: GYAE6OF01CKTUJ.21.4.A04.1.454.CMB.1.raw
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
  modified_base (350)..(350): a, c, t, g, unknown or other
  misc_feature (350)..(350): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgttgttattttacaaggtgtccagtgtgaggtgcagctggtggagtcgtgggggagtacttggtccagtccgtgggacggtccctgacgactctcctgtcgcagcctctgctattccaccttnagtacaaccacaacagtcggacgttcgggcccnccgaacggcctaccgggaaggggtacggggngtaggggaggtcggggtaccgggtacccgttaagttaaccggaaaagggaaacgtaccgttaaaacgtaacggtttaacgaaacggttaacgaaaggtaaacggtacccgggaccggtaccggttaccgttaggggtaacgggttaaaaggggtaaccggtttacccaaacccgtagttacccgtaaaggaaaggaacgtaagttaacgtaagtttaaaccgaaaaacggttaaccttacccgtaagttagttaacctacgttaacgaaactaaacgtaaacggaaaccgtacccgggtaacccgtaaaaccgggaaaaacccgggtacggtaaccccggtaacccggggttaaccgttaaggtttaaagtttaacggtttaacgggggtaaggttaaaaccggaaaacggttaaaggggtacgttagggtagtttaggggttaggggtaacggtacgtccgggttggtaaaccgg

SEQ ID NO: 145613 - DNA, 838 bp, Homo sapiens
  misc_feature: GYAE6OF01E5WW0.21.4.A04.1.454.CMB.1.raw
tcagtcgtcgctcgcacgaccggtgctcgatttagagtagtgatcaggggagctctgagagcggagccccagccccagaattcccaggttgttttcatttggtgatcagcactgaacacagaggactcaccatggagtttgggctgagtcttgggtttttccttgtttgttattttacaaggtgtccagtgtgaggtgcagtcgtgggtggaggttcggtagggggagtacgttggtccaggccgtgggacgggtcccctaggacgtacctccgttcctggtcgccgtacgtccccttacgtcgtacctactttccctaacccgtttcgaacggttaccgaaccccaacgtaaactaggtaccggggtaccggtccgggtccccgaccggacggtcccggtaccgggaaggggggtaacggggtccgtaggggtacgggttccgggggtaccgggtaccgttaaagttaaccggaaaagggtaaacgtaaccgttaaacgtaacgtttaaacgaaaggttaaccgaaggtaaacggtcccgggacggtccggttacgttaagggtaacggtaaaacggggttacggttacccaaccgtagttacccgtaacggaaagtaggtaattaggtaaacttaaccgaaaagtacctactaacttgtaactacgtacgaactaaagtaacgaaacgaccggtaaccgtaaacgggtaaaacccgacgggtaacccgtaccgggttaccggttagtttaaacgttaggtttagggtaacggtaaagaaaacggtaaaggtacgggtagtacggttggttacggggttaggtcgtgtacggttacg

SEQ ID NO: 145614 - DNA, 778 bp, Homo sapiens
  misc_feature: GYAE6OF01BQG7V.21.4.A04.1.454.CMB.1.raw
tcagtcgtcgctcgcacgaccggtgctcgatttagagtagtgatcagggggagctctgagagcggagccccagccccagaattcccaggttgttttcatttggtgatcagcactgaacacagaggactcaccacggtagtttgggcgtgagcgttgggttttcctttgttgtttattttactaaggtgtccagtgtgaggtgcagcgtggtggaggtcgtgggggagtacgttggtccgacgccgtgggacgggtccctgagactctccgtgtcgcacgcctctgctacttcctaccttcagtcgaccacaactacgtggtacgtcgggtccgccgacggtcctaccggagggggacgggcgtgggaggtcgggtccgggtaccgttaagtaacgaaagggaaagaccttaaacgtaggttaacaacggtaacaaaggtaacggtaccggcgtacgttacgtaggtaacgggaaaagggttacggttaccacctaacgttactaacgaaaggagtaatagtaacttaaacaaaacggtaaaccttctaacgtttagtacttcgtaagaacctaaataccgaaacgaacggtacccgtaaacggaaaaaccggtacggaaccggtacccggtacggtttaacgtttaagtttaaggttacgggttaaagggaaacggtaaaaaccgtaaaaaggggttgggttacggggttaaacggtttggggttaacgggggtttaacgggtaaaggtttccggttaaggggtaaccgtaaacccgg

SEQ ID NO: 145615 - DNA, 662 bp, Homo sapiens
  misc_feature: GYAE6OF01D0K8P.21.4.A04.1.454.CMB.1.raw
  modified_base (217)..(217): a, c, t, g, unknown or other
  misc_feature (217)..(217): n is a, c, g, or t
  modified_base (602)..(602): a, c, t, g, unknown or other
  misc_feature (602)..(602): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaggtgtccagtgtgaggtgcagctgggtggagtcgtggggganacgttggtccagccgtgggacgggtccctgacgacttcctcctgtgcagcctctgctattccaccttcagtcaccacaacagtggacgtcgggtcccgcgagggcctaccggaggggaacggggcgtggggaggtcggggtccggaccgttaagttaacggaaaggaaacgtctaaacgtagttaacagtaacagaaacgtcgggcgtcgtacgtaggtaaggaaagggtaacgttccacctatctacgaaagtagaatagaacttacaaagtaacctcgaacttgtatacgtacgaataaagtacgaaacgacggtacccgtaaggaaaaccggacggaaccgtacgggtaccgttagttaatttaggttaggtacgggtaaanaacggtaaaaaggtacggtaggtaagttgggttacgggttggtaacggcgttaggtaccg

SEQ ID NO: 145616 - DNA, 621 bp, Homo sapiens
  misc_feature: GYAE6OF01AZV8Y.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcacctgtctttgctccagggaanacgccacctctcctgcagctccagccagaaatatccgagacgcctaactacatacgcctggtaccagcagaacgcctggccaggcctcccgtacggttcctcgatctagtcgcgttcgggtacccacgcgggcctacgtggccacgtacccagtacgtaggttcaggtggcgtaggtgggtcgtgggacagtacttcactcgtctaattcagttacgctaaggtacgtaggacaccgtaagtaacgtactttacgagtaagttagttactttacgtagtaccgtagtacgtaaggttacgtagggtaacgttactaccgttcgttcggtccggttacggaccggtaacggaaccgtaaaggtaagtaaaggtaacgtaaacggtacgttaggacggtacgtacgacgtacctagttccgttacg

SEQ ID NO: 145617 - DNA, 621 bp, Homo sapiens
  misc_feature: GYAE6OF01EFG1K.21.4.A04.1.454.CMB.1.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgtctcgaggggaaancgccaccctctcctgcagctccagccagaatatccaganctactacatagcctggtaccagcaagaagcctggccaggcctccccgaggtttcccncatctatcgcgtcgggtcccacgacgggcccacgtggccactccccaagacgtaggttacagtcggacaggtcgggtcgtagggactagtaccttcacttctacactctattagactagactggacgtcctaggaacgtacgtttcgacgttagttacgttaactttacgttgtacgacgacgtaagttagtagggtaacgtttccgaccttcgttcggttaccggttaccgggaccgtaaaggggaaccgtaaagggtaaagtaaagtaacggaaaaccgtaacggtaggtacggtacgttacgacctaccgtagttccgttacg

SEQ ID NO: 145618 - DNA, 692 bp, Homo sapiens
  misc_feature: GYAE6OF01BQ8XJ.21.4.A04.1.454.CMB.1.raw
tcagtcgtcgctcgcacgaccggtgctcgatttagagtagtgatcagggggaggagctgctcagttaggacccagagggaaccactggaaaccccagcgccagcttctcttcctcctgctacgtctggcctcccaggctcagaaaccaccggagaaattcgtgttgacgcagtcctccaggcaccctgtctttgtctcgagggaagagccaccctctacctgcagctccagcctagaatactccagagctactacatacgcctcggtaaccagccaagaacgtcctaggacctaaggacctacccaggttcccacgtaatcctaatcgccgttcgggtccccagtaccgggccaacgttcggacactacccagacctacgggttacaacggtgacgtaggtcgggtacctggggaacacgggtacttcgactacctctaatctagttacgcaagaccgtggaacaccgtagaaacggtagtttccgaccgtaagggttacgttagttaaccgtacgggtacaacggactaacggttacgtacgggtaaacgttccaaccgttcgtacgttaccggttacccggacgtaaaccggggtaacctaaacgggttaacgtaaaacgtaccggtaaaaccggtaaccgttacggtacgggttaccgtacgtaccgtaacctaaggttcgttacccgg

SEQ ID NO: 145619 - DNA, 693 bp, Homo sapiens
  misc_feature: GYAE6OF01EGCS1.21.4.A04.1.454.CMB.1.raw
  modified_base (193)..(193): a, c, t, g, unknown or other
  misc_feature (193)..(193): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccagcacctgtcttgctcagggaantccacctctcctgcagctccagccaagaatactccagagctaactacatacgcctaggtaccagcagaagcctggccaggcctccgacggtttcctcagtcctagtcgcgtcgggtcccacgacgggccaacgtggaccacgtcccgaagacgtacggtttacgacggttcggaccgtaagggttcggggttaccgttacgggggaacaacggtacctttaccgacttcctacgtaacgttactaacgtttaacgacgtaacgtaacggtaggaccgtaccgtaggaacgttagtttccgacttagtagttaactttactacgtacacgtacgtaagttagtacgggttaacttccgtaaccgttcgttacggttccggttaccgggaacccggtaaacggggtaaacccgtaaagggtaaacggtaaaacgttaacggaaaaaccggtaaccgttagggtaccggtacgtacgaacctaaccgtagttccggtttaccg

SEQ ID NO: 145620 - DNA, 842 bp, Homo sapiens
  misc_feature: GYAE6OF01B5ARD.21.4.A04.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttattttacaaggtgtcagtgtgaggtgcagctgggtggagtcgtgggggatacgttggtccagccgtgggacgggtccctgacgtacctctccgtgtgcacgtccctgtcgctattccaccttcagtacgaccaacaacagtcggaccgtcggggtacccncgacggccgtaccggaaggggaacggggtcgtaggggacgggttcggggtaccggtaccgttaagttaaaccggaaaaggtaaacgtaccgttaaaacgtacggttaaacgaacgttaacgaaggtaaacgtacccgggcggtaccgttaccggttaaggtaacgggaaaagggtaccggtttacccaaacctagttaccgtaaacgaaaaggtagtaacttaaggtaacctttaaacgaaaaacgtacctttaactacgttaagttaacctacggttaaaccaaacggttaaaagttaaccggaaaccgtaccggttaaaccccggtaaaaaccgggaaaaccgggtaccgggtaaacccgggtacccgggttaaccgttttaagggttaaacttttaccgggtttaaggggtaaaccggtttaaaaggaaaacggttaaaacgggtacggggttagggttaaaccgtttgggggttaagggttaggttaacgggtcgttaggggtaaacccg

SEQ ID NO: 145621 - DNA, 735 bp, Homo sapiens
  misc_feature: GYAE6OF01DRV7T.21.4.A04.1.454.CMB.1.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagcctggacgggtccctgacgactctcctgtgcagcctctgctattccaccttnagtcgaaccacaacatggacctggggtcccgccgaggctccggaggggaacggggtctagggacggtcgggtaccggccgttaagttaaccgaaaggaaacgtcctaaaacgacggttaaaccaagtaacaaggaaacgtccggggcgcggttactaggtaaggaaagggtaacggttaccaacccgtattaccgtacgaaaggagtaactaggactttaaccgaaaaggtaaccttactaaccgttaggttaacttaccgtaggaactaaaaacgtcgaaaaacccaggtaaccccgttaaacgggaaaaaaccccggtagggaacccgtaaccggggtacccttagggttaaactttaaggtttcggtaagggtaaacgaaacggtaaaaaagggtacggttagggaaacgtttgggttaacgggttaggggttaacgtcgttaggtaaccgg

SEQ ID NO: 145622 - DNA, 775 bp, Homo sapiens
  misc_feature: GYAE6OF01E2OR2.21.4.A04.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgctccgaggggaaancgcccaccctctcctgccagcctccagccaagaactactcccgaagacgccttaactacatacgcctggtaccagcagagcctggccaggcctacccgtagttccctnatctagtcgcgtcgggtacccaggacggccacgtggacctacgtccccgaaggtccgtacggtttcgagggttcgggaccgtagggtttcgggtaccgtaggggactacgtacctttacgaccttctacgattacagttacgcaagtacgtggaacgtacgtaggtaaacgttacgtttaccggacgttaaggttcgtttaacttaccgtacggtaccgtaaggtaccgttaaagggttaacgttaacggggtttaaacctttacccgttaacccgtttacgttaccgggtttaccccgggttaccgggaaaccccggtaaaacgggggtaaaccccgttaaaaggggttaaacggttaaaaaccggttaaaccggggtaaaaacccgttaacggttacgggttacccgggtaacccgttaccggtaaaccccgtaacccgtttaaccgttcccggtttttacccg

SEQ ID NO: 145623 - DNA, 661 bp, Homo sapiens
  misc_feature: GYAE6OF01A30MW.21.4.A04.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctacagaaaccaccggagaaattgtgttgacgcagtctccaggccaccctgtctttgtctccgaagggggaaacgacgcccaccctctccgtgcagcctccagccaagaatacgtccagagctactacatacgcctaggtaccagcaagaacgccgtaggcccaggcctaccccgaggttcccngactctagtcgcgtcgggtcccacggacgggcctacgtggaccacgtcccgaagacgtaggttccagggtcggcgagggtcgggtctaggggaactacggtactttccacgttctacgaatacgtagttaacggactaacggtacgtacgggacgtacccgtaaggtaaacgtacgtttcggacgtagttagttactttaacgttgtacgagtactaagttagtaggtaacttacgtaccgttgttaccggttcgttccggacggtaaacgggaaccgtaagggtaacgtaaagtaacggaaaaccggtagttaggtacggtactacgactacctagttcgttacg

SEQ ID NO: 145624 - DNA, 726 bp, Homo sapiens
  misc_feature: GYAE6OF01APOAO.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaanacgccctacctctccgtgcagcctccgacgccaagtaactactaccgaggacgtacctaactacatacgcctaggtaaccagacaggaacgcctcggccacggccttaccccgtacggtttcccactattctagtccggtacgttccgggacccacggtacgggcccagtcggacctactacccgaaggtaccgtaggttacaggtggccgtagggttcgggtcgtacgggacctacggtaccttcgtacccttcgtacctacgtacgtaacgttacgacgaacggttacgggtacgggaacgtccgtaagggttaaacgttcgttaccggacgttacgtttagttaccgtttacgtcgtacaggtaccgtaaggttacgtacgggttaacctccgttacgttcgttaccgggttaccggttaccggaacggtaaaccggggaaactaaacgggttaaggtaaactaacgggtaaaaccgttcggtgggtaccggtctaaccggacttaccgtagttccgttacg

SEQ ID NO: 145625 - DNA, 688 bp, Homo sapiens
  misc_feature: GYAE6OF01DFUPK.21.4.A04.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttgctccaggggaangccacctctcctgcagcctccagccagaatacnccagagctactacatagcctggtaccagcagaacgcctggccaggcctcccgaggttccctcgattctatcgcgtcgggtcccagacgggcctacgtcggctaacctcccgaagaccgtaggtttaccaggttcggacgtagggttcggggttacgtcggggaaccaggttaacccttcgaacctttcgtactaactctaacgttagaccgtaagaccgttagggacgtaccgttaaggaacgttacgtttaccggacgtaaggtttatttaactttacgtcggtacgaggtacttaggttaacgttacggggttaaactttccgtaaccgttttcgttacgggttacccggtttacccgggaacggtaaaccggggtaccgtaaagggttaaacgtaagttaacggaaaaccgttacgtaggtacgggtctaaccgacaacccgtgttcccgttacg

SEQ ID NO: 145626 - DNA, 667 bp, Homo sapiens
  misc_feature: GYAE6OF01BZ85E.21.4.A04.1.454.CMB.1.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgcccaccctctcctgcagcctccagccagaatactccaggcnctactacatacgccgtggtaccagacagaacgcctggccaggccctccccgtaggttccctcacttcttagtcggtccgtcggggtaccccacggacgggccctacgtcggaccacgtcccgaagaccgtaggttcgaggtcggctagggtgggtcgtgggacagtacttcgactctacatctagttacgcgaacgtcgttaggacgtccgtaggtaacgtacgtttccggacgttaggtttacgttactttacgtgtaccgagtacgtaaggttagtacggttaaccttccgtaccgttcgttcggttaccggttaccgggaccggtaaacggggtaacccgtaaagggtaacgttaaaggtacggtaaaaccggtacgttcgggtacggtaccttacggacctaaccgtagttccgttacg

SEQ ID NO: 145627 - DNA, 784 bp, Homo sapiens
  misc_feature: GYAE6OF01C1XQC.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggaagaaattgtgttgacgcagtctccagctacctgttctttgtctccgaaggggaaanctcccaccctctcctcgcacgcctaccgacgaccaagtaactactaccgaagacgtaccttaacctaactaacgttacggacccgttacgggaaacccaggaccaaacggaaacggtcccgtacgggacccgtaacggtccccttaccccgtaaggttttcccctacgtacttccgtaacgttcggaaccggttccgggaccccaacggacggggtacccctacggttcgggacctaaccggtaccccgaagtaccggtaacggtttccgaagggttcggacggtaggggtcggttaccgaggggaacctacgtaccgttacaccgttcgtactacgttactaagttacgacgtaacggtacgtacgggtaacttaccgtaaggtaaacggttacgtttcggaaccgtttaagggtttaccgtttaagtttaaccgtgggtaaccgtaacggtaccgttaagttacggtaagggttaaccttaccgtacgtttcgtacggttaccggtacggaccggaaacggtaaccgtaaggtaacgaagtacgaacgtacgtgacgtactacgactactagtgttacg

SEQ ID NO: 145628 - DNA, 689 bp, Homo sapiens
  misc_feature: GYAE6OF01B3892.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggccaccctgttctttgtcctaccgaagggggaaagcgcccaccccttctcctgcagcctccagccaagaatactccagagacctaactacatacgcctacggaccagcgaagaacgcccgtcggaccgacggtccctacccgtaggtttccctacgtactctagtcggtccgtccggggtacccacggaccgggccctacggtcggaccaccgtacccgaagtaccgtacggttacgacggtacgggacgtaggttccggggtacgtacggggaacctacggttaccctttacgtaccttccgtacacgttacgtagttacgacgacgtacgtggaaccgtcgtaggtacgttacgttacgatacggttcgttaatttcgtagtaccgtagtacctaggtacgttacggtacttccgtacgttcgtacgttaccgggtcgaaccggtaaacgggtaaccgtaaaggtaacgtaagtaacggaacgtacgtggtcgtactacgactacgtatcgttacg

SEQ ID NO: 145629 - DNA, 759 bp, Homo sapiens
  misc_feature: GYAE6OF01EFDEQ.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctcgagggaancgcccacctctcctgcagctccgagccagaatactaccagacgactactacatacgccgtacggtaccagcaagaacgcctagggaccgaggtccgtcccgtaacggtttccctactaacgttcttagtcgtccgttaccggggtacccaacggacggggtacccaacgttcggacctaccgtacccgaggtaaccgtacggttacgacggtggacgtggtcgggtcgtgggactacgtaccttctacttctacgtactactacgttacgacgtaggacgtacgggacgtaccgtaaggtaacgtcgtttacggtacgtagggtttactttaacgtttacgtacggttaccgtaacggtaacgttaggttaacgtacggggttttaacctttacccgtaaccgtttccgggttacggtttaccggttacccgggaaacccggtaaaacgggtaacggtaaaacgggttaaacgggtaaaagtaaacggggtaaaaccggttaaacggttacgggtaaccggtacccgttaacggtaccccgtaaccgtagttccgtttaaccg

SEQ ID NO: 145630 - DNA, 718 bp, Homo sapiens
  misc_feature: GYAE6OF01A04JC.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaancgccaccctctcctgcagctccagccagaactatccagagctaactacatagcctggtaccagcagacgcctggccaggcctcccgacggttcctcattcctatcgcgtcgggtcccaacgagggccacgtggcactcccagacgtggttcaggtggcctaggtcggtcgtaggggactacggtactttcgaacttctacgactacgtattacgcgtagacgttagggacgtccgttaggaaacgttacgtttccggtacgtaacggtttacggttaacgtttacggttacggtaccgaagtacggttaacggttacggttagggtaaacggtttcccgtaaccggtttcggttacccggtttccgggttaccgggaacccggtaaaccggggttaacccgtaaaaggggttaaaccgtaaacggtaaacgggtaaaacccgttaaccggttaccgggttaacgggtacccccgtttaaggaaccccttaccttaaccggtttaccgtttaccccggg

SEQ ID NO: 145631 - DNA, 713 bp, Homo sapiens
  misc_feature: GYAE6OF01EUJWT.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccacggagaaattgtgttgacgcagtctccaggcacctgtcttgctcgagggaaancgccacctctccgtgcagctaccgagccaagaactactccagacgtcttaacaacagtacgccgtacgtaaccacgacaagaacgccgtacgggaccaagggtccctacccgtaacggtttcccacgtacgttccgttagtcgtaccggttccgggtacccaacggacgggacctacggtcggacctaccgtaccgaacggtacgtacggtttacgacggtcgggactaggggtcgggtacgacgggtaactcggtaacttcaaccgttcactacgttacgtaacgttacgacgtaacgtacggttaggacgtaccgttaggtaaacgttcgttacgacgtaagtttagttaacgttacgttacggtactaggtactaaggttacgtacggttaacttaccgtacgttagtacggttaccgttacggaaccggaaacgggtaactaagggtaacgtaaagtaacggtaaacgtacggttagtacggtacgtacgtaacgtaccgtgttccgttacg

SEQ ID NO: 145632 - DNA, 656 bp, Homo sapiens
  misc_feature: GYAE6OF01AU31T.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgctccgaggggaaanacgcccaccctctcctgcagcctccagccaagaactactccagacgctaactacatacgcctaggtaccagcagaacgcctcggccagggcctcccgaacggtttcccacagttctagtcggtaccgtcgggtacccacggacgggtcccacgttcggccaacgtcccgaaggtacgtaggttcaaggtggcctagggtcggtcgtagggaacctacggtccttaccacgtcctacaacgtactagttacgcgtaagtacgttaggacgtacgtagtaagttacgtttcggacttaggttacgttaattacgtcgtacgagtcgtaagttagtacggtaacgttcgtactcggttcgttccggttacggaaccgtaaacgggtaaacctaagggtaaacgtaaagacggtaaacgtaacggttcggtaacggcttacggactaccgtgttcgttacg

SEQ ID NO: 145633 - DNA, 895 bp, Homo sapiens
  misc_feature: GYAE6OF01A38PO.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggagacgttggtccagtccgtgggacgggtccctgacgactcctccgtgtcgcacgtcctctgctattccaccttcagtcgaaccacaacagtcggacgtcgggtcccgccgaggcctaccggaggggaacgggtcgtagggagggttcgggtaccggtaccggttaattaaccggaaaagggtaaacgtaccgttaaaacgtacggtttaaaccgaacggttaaacaaacggtaaacggtacccgggtaccggtaccggttacgttaagggtaacgggtaaaaaggggtaacgggttttacccaaaaccgttaacgttaccgtaaacgggtaaaacggtaagggtaacgttaacgtaaaccgtttaaaccgaaaaaacgggtttaacccttacgttaaaccgtttacggttaaactttcccggaacggtaaacgtaaaacgttaaccggaaaacccgtaaccgggtaaaccccgttaaaacggggaaaaaacccccggtcggggtaaaaccctaaccccgggggtttaccgtttaacgggtttaaagttttaaaccggtttaacgggttaaaacgggttaaaacgggtaaaaccgtaaaaaagggggttgggttaaagggtaaaggttttcgggggttaagggtttaacggggtaacctttcgggttaagggttaaacccgg

SEQ ID NO: 145634 - DNA, 566 bp, Homo sapiens
  misc_feature: GYAE6OF01A6RKD.21.4.A04.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (289)..(289): a, c, t, g, unknown or other
  misc_feature (289)..(289): n is a, c, g, or t
  modified_base (385)..(385): a, c, t, g, unknown or other
  misc_feature (385)..(385): n is a, c, g, or t
  modified_base (457)..(457): a, c, t, g, unknown or other
  misc_feature (457)..(457): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccaccctctcctgcagctccagccagatatccaganctactacatagcctggtaccagcagaacgcctggccaggcctcccgaggttccnatctatgctcgggtcccagacgggcccagtggacctactacccagtactacgggttcaggtcggacaggttgggtctggggaactaggtacctttnaaccttcgtctatctattagctaagcgtaggacgccgtgaagtatttcgtacgtagtgtattactgtctagngacgtagtaggtaagttcaccgtcgttcgtccggttcggacgtaaacgggacctaagggtacgtaaagtacggaaacgacgttgtaggctacgacctacctagtcgtcg

SEQ ID NO: 145635 - DNA, 731 bp, Homo sapiens
  misc_feature: GYAE6OF01BSJYU.21.4.A04.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (409)..(409): a, c, t, g, unknown or other
  misc_feature (409)..(409): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccacctctcctgcagctccagaccaagaatactccgagacgctaactacatacgcctaggtaccagcagaacgcctgccagtcctccaggttccanatctatcggcttacgggtcccagaggaccacgtcgacacncccgagaccgtaggttccaggtcgctagggttggcgtagggactaggtaccttcgacgttcactaacgttnaacgtttacgaactacggtaacgtagggtacgtccgtaaggaaacgttacttttaccgggacgtttaaggtacgtttacgttaacgtttaccgtaggtaacgttaacggttaagggttaacgttaccgggtaaagtttaccccgtaccgtttacggttacccgggttacgggttaacccgggtaaacccggtaaaggggtaaccccgttaaaaaagggtacggttaaaaaaccggaaccggttaaaaacgggtaacccggttcgggttaaaacgggtcccgtaacggtaacctaacccgtaaaggttttcccggttaaacgg

SEQ ID NO: 145636 - DNA, 689 bp, Homo sapiens
  misc_feature: GYAE6OF01DBYEK.21.4.A04.1.454.CMB.1.raw
  modified_base (274)..(274): a, c, t, g, unknown or other
  misc_feature (274)..(274): n is a, c, g, or t
  modified_base (544)..(544): a, c, t, g, unknown or other
  misc_feature (544)..(544): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccagtggtagtttgggctggagcgttggtttccttgttgttatttacaaggtgtccagtgtgaggtgcaggcgtgggtggaggtcggtgggggagtacgttggtccgagtccgtgggacggtccctgacgtctccgtcctgtcgacncgcctcgtcgctacttcctaccttcgacgtcgaacccataaccgtagtacggaccgtcgggtacccgccgacggtccgaccgggaagggacggggtcgtggggtaggtcgggtccggtaccgtaagttaaccggaaaaggtaacgtactaacgtacgtaccgaagtacgaagaacgtacgcgtacgtgtagaggtaacgtagtaccatacgtactaacgaagtactagtaataacgtaacaaacggtactacgtagttacgtactcgtanaacgtaagacgtaaccgaccgtacgtaaacgggaaccgacggtaacgacccggttagttagaaacgtttggtacggtaaaggttaaagaacgggtaaagtcggtaacggttggtaggttaggggtaactggtacgtagggtaacc

SEQ ID NO: 145637 - DNA, 722 bp, Homo sapiens
  misc_feature: GYAE6OF01BC0W0.21.4.A04.1.454.CMB.1.raw
  modified_base (284)..(284): a, c, t, g, unknown or other
  misc_feature (284)..(284): n is a, c, g, or t
  modified_base (602)..(602): a, c, t, g, unknown or other
  misc_feature (602)..(602): n is a, c, g, or t
  modified_base (674)..(674): a, c, t, g, unknown or other
  misc_feature (674)..(674): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttgggctgagcgttgggttttccttgttgtttatttacaaggtgtccagtgtgaggtgcagctggtggagtcgtgggggagtacgttggtccagccgtggacggtccctgacgactctcgtgtgcagcctctgctattccaccttnagtcgaccacaacagtggacgttcgggtcccgccgacggcctcccggaagggggaacgggccgtgggaggtcggggtccggtaccgttaagttaaccgaaaggtaaacgactaaacgtacggttaacacgtaaacaaggtaaacgtaccgggacgtcggttcgtaggtaagggaaacgggtaacggttccaaccgtactacgtaacgaaagaagtaataaggttactaaccgtaaaaggtaacctcgtaaacgttgtaacttactacggtaactaaactacggaaaccacggtaacccgtaaacggaaaaacccgggnggtaacccgaaccgggtacccgttaagttactttaacggtttaggtaacgggtaaagaaacgtaaaaagggnggttaagggaagttcggggttagggtaggttacggcgttggtaaccgg

SEQ ID NO: 145638 - DNA, 790 bp, Homo sapiens
  misc_feature: GYAE6OF01DSQJC.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttattttacaaggtgtccagtgtgaggtgcagcgtgggtggaggtcgtgggggagtacgttggtccacgccgtgggtacgggtccctggacgtacctctccgtgtcgcacgcccttctcgctacttcctaccttcgagtacgaaccaaccaacgtagtcggtaccgtcggggtcccgaccgacggcccgtaccggaagggggaacggggtcgtagggacggggttcggggtaccggtaccggttaagttaaacggaaacgggtaaacgtaaccgtaaacgtaagttaaccaaggttaaacaaggtaaacgttaccgggcgtacggttacggtaaggtaagggtaaaacgggtacggtttaccaaccgtaacttaccgtaacgaaagtaaggtaacgtacgtaacgttaaacgtaaagtaaccttacgtacgttacgtaacttacgtacgaactaaacgtaacgaaacgaacgtaacccgtaaacggaaaaccggtacggtaaccgtaacgggtccgtttaaggttaacgttaaaggtttggtaaacgggtaaacgtaaaacggtaaaaaggtagggttaacggtaagttggggtaagggttggttaaggtccgtaggtaaccgg

SEQ ID NO: 145639 - DNA, 892 bp, Homo sapiens
  misc_feature: GYAE6OF01EZAZF.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggccacctgtctttgtctacgaggggaaacncgccaccctctcctgcagcctaccgagaccaagaactactaccaaggactacctaactaacattaacggccttacgggtaaccaagacctaaacggaacgtcccgtacggggaccctaacgggtccccttacccccgtacgggtttcccctacgtaacgtttaccgttaacggttccggtccggtttacccggggtaccccccgaacgggtaacccgggggacccccttaacccgggttcgggaacccctaaacccgttacccccggaaaaggggttaacccggttaacggggttttaccgaaacgggggttccggggtaccgggttaacggggtttccggggggttaccgggtaacgggggaaaccgttaaccgggttaccctttaccgtaacccgtttcctaacgtaacgttaccgtaacgtttaacggacgtaaacggtaccggtacgggtaactaccgttaagggtaaacgttacgtttaccggacgtttaaggttactttaacgtttaccggttcggtaacgtaacggtacgtaaggttacggttaacgggtaacctttaccgttacccgtttcggttacggttaccggttaccgggaacggtaaaccgggtaacgtaaagggtaacgtaaagtacggtaaaacggtacggtaggtacggcgtacgacctacgttatccgttacg

SEQ ID NO: 145640 - DNA, 776 bp, Homo sapiens
  misc_feature: GYAE6OF01E1GFB.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaanctccaccctctcctgcagctccagccagaatactccagacgctactacatacgcctaggtaccagcaagacgcctggccaggcctcccgaggttcctcatctagtcgcgtcgggtacccacgacgggcccacggtcggacctactcccgagacgtacggttccagggtcggacgtaggggttcgggtacgtaggggactacgtacctttcaccgttccttactaacgttacctaagttacggaccgtaacggtaccggttagggaaccgtaccgttaacggtaaacggttacgttttaccggaccgttaagggtttacgtttaacgttttaccggttacggttaccgtaacggtaaccgttaagggttacggtttaacggggttaaaccgttttacccttacccggtttcggtttaccgggtttacccgggtttaccgggaacccgggtaaaaccggggtaaaccggtaaaacggggttaaacggtaaaacggttaacgggtaaaaaccgttacggttacgggttaacggtaccggttaacggtaacccgttaacccttacgttccggtttacccg

SEQ ID NO: 145641 - DNA, 669 bp, Homo sapiens
  misc_feature: GYAE6OF01BYZZ3.21.4.A04.1.454.CMB.1.raw
  modified_base (199)..(199): a, c, t, g, unknown or other
  misc_feature (199)..(199): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaancgccacctctcctgcagctccagccaagaatactccagacgctactacatagcctggtaccagcagaagcctggccaggcctccctaggttcctacatctagtgcctcgggtcccacggacgggcctacgtcggcacgtcccaggactaggttcaggtcggctgggtcggtgtacgggactaggtacctttcgacttcgtanactactagttacgcgtaacggtacgttagggaacgtccgtaagtaaacggttacgtttcggacgtaggttacgtttacgtttaacgttggtaccgtaaggtaccgtaaggttaagtaacgggttaacggtttccctaaccgtttcgttacggttaccggttacccgggaaccgtaaacggggtaacccgtaaagggtaaacgtaaaagttaacgggtaaaccgtaacggtcggtacgggtactacggtactaccgtagttcgttaccg

SEQ ID NO: 145642 - DNA, 724 bp, Homo sapiens
  misc_feature: GYAE6OF01AQ4P9.21.4.A04.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccagctcagaaaccacggagaaattgtgttgacgcagtctcaggcaccctgtactttgctccgaggggaaancgcccaccctntcctgcagctccagtccagaactacnccagacgctaactacatacgcctggaccagcagacgcctgccaggcctcccgaggttcccnctatctatcgtcgtcgggtcccagacgggccactgggcctaacgtcccagaccgtacggttcacggtggcagggtcggtcgtgggacacgtaccttctacctctaccgtactctaattacgacgaacgtacgtaggtacggtaccgttaaggtaacgttacgtttaccgacgttacggtttacgtttaagttttacgtacggtttaccaacggttaccgttaaggtttagttaaccggggttaacctttcccgaacccttttcggttcggttacccggtttaccgggaaccccggtaaaacgggggtaaacccgttaaacggggttaaacggtaaacgttaaaacgggtaaaccggtttaaaccgggtggttaaccgggtaccgtttaaccggaccccgtaaacccttggtttaccgttttacccggg

SEQ ID NO: 145643 - DNA, 527 bp, Homo sapiens
  misc_feature: GYAE6OF01ESK4U.21.4.A04.1.454.CMB.1.raw
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
  modified_base (492)..(492): a, c, t, g, unknown or other
  misc_feature (492)..(492): n is a, c, g, or t
  modified_base (518)..(518): a, c, t, g, unknown or other
  misc_feature (518)..(518): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaggttgtccagtgtgaggtgcagctggtggagtcgtgggggagacttggtccagccgtggagggtccctgagactctcctgtgcagcctctgcattcaccttcagtgaccacaacatggactgggtccgccaggcctccagggagggctgggagtgggtcgcgtagtacaaggaanctaanagttacagtaacagaatacggcgcgtctgtagaaaggagttcacatcanaacganatgaattacaaacgactcaacgtgtatctagacaaagtgaacncgactagaaacgngacacggccgtatacgttatgtaggtanaacaaagacgtggatcggtagtaggngtctgtacg

SEQ ID NO: 145644 - DNA, 858 bp, Homo sapiens
  misc_feature: GYAE6OF01B727I.21.4.A04.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcacctgtctttgctccgaggggaaancgccaccctctcctgcagcctcagccagaatacnccaagacgctaactacatacgcctggtaaccagcaagaagcccgtggacccagggtccctacccgtagggtttcccactacttctaagtcggtccgttacggggtaccccaaggacggggccctaacggtcgggaccctaacgttccccgaaggtaaccgtacgggtttaccgaacgggtttcggggaccgttaaggggttcggggttaccgtacgggggaaacctacgggttaaccttttccgaaccgtttccgttacaactttaccgtaagtttaacggaccgtaacgggtacgttacgggtaacgtaccgttaacggtaaaggttacttttaccggtaacgtaaggtttacgtttaacgtttaacgttacggttaaccgtaacggtacgttaaacggttaacggttacgggttaaacggtttacccttaaccgtttccggttaccggttacccggggtttaacccgggtaaaccgggtaaaaccgggggtaaacccggtaaaacgggggtttaaaccgaaaaagggttaaccgggtaaaaaccggttaaacggttaccgggttaccggggtaccgttaacgggttaacccctaaacccggttaacgtttcccggtttaaccgg

SEQ ID NO: 145645 - DNA, 677 bp, Homo sapiens
  misc_feature: GYAE6OF01C0JN2.21.4.A04.1.454.CMB.1.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccgaggctacaacgaaacccacggagaaattgtgttgacgcagtcctcaggcaccctgtcttgctcgaagggaancgccaccctctcctgacacgcctaccagaccaaagtaactactaccagacgactactaacatacgccgtacggtaaccngacaagaacgccgtaggaccgacggtccctaccgacggttccctacgtacttctacgtcggtccgttaccgggacccaacggaccgggacctacgcgtacctaccgtacccgagtaaccgtggttacgacggttaggacgtggggttcggtcgtacggggaactacgtacttcgaaccttcaccaacactacaacgacacgtcgctacgagtacttagttcgacgtagtacgtacttacgtagtacgtagtagttacgtaggttacggtacgtaccgtaaccgttacgttaccgttacggacggtaacgggtaaccgaggggtaagtacgtaacggtaacgaacgggtacccggttagtacggtacgtacggtacgacctaacgtcggttctaccg

SEQ ID NO: 145646 - DNA, 774 bp, Homo sapiens
  misc_feature: GYAE6OF01EUK0V.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtcctccaggccaccctgtctttgtctcgaagggaaancgccaccctctcctgcacgcctaccagccaagtaactactacccgaagacgaccttaactacaacgtacgaccgttacggtaaccaggtaccgaaaggaaccgcccgtagggacccgaacgggtccccttacccccggtaacgggttttcccctacgtaacttccgttaagttccggtacccggttaccggggtacccccaacgggtaaccggggtaccctaacggttcgggaccctaaccgtacccccgtaaaggaaccggttacgggtttaccgaagggtccgggtacgtaggggttcggggtaccgtaggggaacctacggtacctttcgaaccgttccgtactaattacgtaagtttacgaccgaaggtacgttacggaacgtacgtaggtaacgttacgtttacggacgttagttacgtttacgttacgtcggtacgagtcgtaagtacgtacggtaacttcctaccgttgttcggttaccggtacggaaccggtaaacggaacgtaaaggtaacgaaagtacgtaaacgtacgtaggacgtacgacgtaccacgttgtcgttacg

SEQ ID NO: 145647 - DNA, 803 bp, Homo sapiens
  misc_feature: GYAE6OF01BEYO2.21.4.A04.1.454.CMB.1.raw
  modified_base (119)..(119): a, c, t, g, unknown or other
  misc_feature (119)..(119): n is a, c, g, or t
  modified_base (185)..(185): a, c, t, g, unknown or other
  misc_feature (185)..(185): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
tcagtcgtcgctcgcacgaccggtgctcgatttagagtagtgatcaggggagctctgagagcggagccccagccccagaattcccaggtgttttcatttggtgatcagcactgaacacngaaaaaaggctcaccatggagtttgggctgagcttgggtttttccttgttgttattttacaaggtntcagtgtgaggtgcagcgtggtggagtcggtgggggatacgttggccagccgtgggacgggtccctgacgtacctctcctgtcgcncgtcctntcgctacttcctaccttcaggtacaacccaacaaacgtagtacggaccgtcgggtacccgaccgacgggtcctaccgggaagggggacgggtcgtagggtagggtcgggtccggtaccgttaagtaacggaaaggtaacacgtaaacgagttaacgagtaacgaagaacgtacggcgtcgttacgtaggtaaggaaacgggtacgtacaacctacgtactagaagtaacgtagtagtaacttaacaaacgtaacctacgtaacgttacgttaacgttaccgtaacggtaactaaaaggttaaccggaaaaccgtaacccgggtaaccccgtttaaaaacggggaaaaccccgggtacgggtaaaccccggtacccgggttaacccgggtttaaatttaacggttttaaacggttaaggggtttaaacgggtaaacggtaaaaacgggttaaaagggttcggttaaagggttacggtttacggggttagggttacggggtaacggttcggttaagggtaacccggg

SEQ ID NO: 145648 - DNA, 802 bp, Homo sapiens
  misc_feature: GYAE6OF01DNXQ6.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtcctccgaggccacccgttgttctttcgtcctaccgaaggggaaacgcgcccaccccgtctcctgcacgcctccagccaagaactactccagacgctaactacagtacgtccgttacggaacccaggacaacggaacgtcccgtacggacccgacggtcccttaccccggtacggtttccctactaccttacgtacggttcggtcccggttaccggggtacccccaacgggtaccgggtacccctacggtcgggaccctaaccgttaccccggaaggtaccgttagggtttaaccgacgggttcgggcgttaggggtttcggggtaccgtacggggaacctacggttacccttaccgtacgttcctacgtagttaccgttaacgttaccggaaccgtacggtaccggtagggtaaccggtaccgttaaaggtaccgttacgttttacggacgtttagtagtttaaccgtttcgttacgtacgaggtacgttaggttaacggtacggttacgttcccttacgttcgttcgggttccgtaaccggtaccggtaaacgggtaaccgtaaagggtaaaacgtaaggtaacggaaacggtaccgttaggcggtacgtacaccgtaactcgtacgtttaccg

SEQ ID NO: 145649 - DNA, 826 bp, Homo sapiens
  misc_feature: GYAE6OF01CSPGT.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanctcccaccctctcctgcagcctccagcccaagaatactccagacgcctaactaccatacgcccttagggtaacccaggaccaacggaacgcccgtcgggacccacgggcccttccccgacggtttcccctactacttctagtcggtccgtcggggtaccccacggacggggtcccctaacggttcgggacctaaccgtaccccgaaggtaaccgtacgggttacgaacggttcggggccgttaaggggtcggggttccgtaagggggtaaccctacggttaacccgtttccgaaccctttccgttaccgaacgttacctaacggtttaacgaccgtaacgtaccggtagggtaaccgtcccgttaaggtaacgtttacgtttccggacgttaacggtttacgttaacgtttaccgtggttaaccaggtactaagggttacggttaacgggtaacgtttacccgtaccgtttccggttacgggtttccgggtttaccgggaacccggtaaaaccggggttaacccgtaaaaggggtaaaccgtaaaaggttaacgggtaaaacccggttaaccggttgggtacgggtaccttacgggtaccctaaccgttaccggtttcgtaccgg

SEQ ID NO: 145650 - DNA, 842 bp, Homo sapiens
  misc_feature: GYAE6OF01DKVO9.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccaccggagaaattgtgttgacgcagtctccaggcaccctgtctttgtctccgaaggggaanactccaccctctcctgcagcctccagccaagaatactccagacgctactacatacgccgtggtaaccagacgaagaacgccgtacggaccgacggtcctaccccgtacggtttccctactaacttacgttacgtcggtccggttaccggggtaccccaacggaccggggtaccctaacgttcgggaccctaaccgtccccgaaggtaaccgtacgggtttacgagggtcggaccgtaggggttgggtaccgtaggggaacctacggtaccttctaaccttcctacgtaataccgtaattacggactaaggtaaccgttagggtaaccgtaccgttaaggtaaaccgtttacgttttaccggaacgtttagggtttacgtttaaacttttacccggtaggtttaacccgaacggtaaccggttaaggtttaaacggttacggggttaaaacccgttttccctaacccgtttcgggtttaccgggttacccgggtttaaaccccggggaaaccggtaaaaccgggggtaaacccttaaaagggggttaaaacgtaaaaccggttaacgggtaaaaacccggtaacggtttcgggtacgggtacccttacgggaacccttaaccgttagttccggtttaccg

SEQ ID NO: 145651 - DNA, 957 bp, Homo sapiens
  misc_feature: GYAE6OF01CRAXP.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggaggagctgctcagttaggacccagagggaaccatggaaacccagcgcagcttctcttcctcctgctactctggctccaggctcagaaaccaccggagaaattcgtgttgacgcagtctccaggcaccctgtctttgctccgaggggaaacncgccacctctcctgcacgcctccagccaagaactactccagtacgtctaactacacgtacgccgttggtaaccagacaaggaacgtccgtaggacccaagggtccttacccgacggttttccctacgtacttacgttacgtcggtccggttcccggggttaccccaacggtaccggggtaccctaaccggttcgggaccctaacctttccccggaaggtaccgttacggtttaccgaagggttcgggacggtacggggttacggggttccgtagggggaaaccctacgggttaccgtttaccgtaccgtttccgtaccgttaacgttacccggtaacgtttaacgggaccggttaaacgggtaccggttacggggttaaacccggttaccggtttaaacgggttaaaccggtttacggtttttacccgggaaccgtttaacgggttttacggttttaaaaccttttacgggtttacgggttaacgttaaacggttaccgttaaacgggttttaacgggtttaacggggtttaacccggttttaccgtaccccggttttacgggttaccgggttttaacccggggtttacccgggaaaccggggttaaaaaccggggggttaaccgtaaaacggggtttaaaacggtaaaacgggttaaaccgggtaaaaacccgggttaaccggtttaaccggggtaccggttacggttaaacccggtacccgttaaacccgtttccgttacccgggttttacccg

SEQ ID NO: 145652 - DNA, 662 bp, Homo sapiens
  misc_feature: GYAE6OF01BRR65.21.4.A04.1.454.CMB.1.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaanacgccaccctctcctgcagcctccacgccaagaactactccgagacgctaactacatacgcctaggtaccagcagaagccgtggccaggcctccgaggttccncatctagtcgccgtcgggtacccacggacggccacgtcggaccacgtccgagacgtaggttcaggtcggacgtagggtcggtcgtagggactacggtaccttcgtactctactactacgtacttacggacgtacgacgtcgggtaacgtccgtaaggtaacgtttacgttacggacgttaggtttacgttaacgtttacgtacgtacgtagtacgttaaggttacgtacgggttaacgttccttacgttcgtcggttacggtaccgggaacgtaaccgggaaacgttaagggtaaacgtaaagtacggtaaaaccgtacggttacgtacggtacttacggaactaccgtagtcgttaccg

SEQ ID NO: 145653 - DNA, 764 bp, Homo sapiens
  misc_feature: GYAE6OF01CVLE9.21.4.A04.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcaacgaaaccaccggaagaaattgtgttgacgcagtctccaggcctaccctgttctttcgtctccggaaggggaaancgcccaccctctcctgccagcctccgacgaccaagaactactaccgaagtacgtacctaacctacacgtacgtcccgttaggtaacccagaccgaaggaaccgtcccgtacgggacccgaacgggcccttaccccggtacggttccctacgtacttccgtagttccgcccggtccgggtaccccgaacggaccgggccccaacggtcggaccaccgtacccgaagtaacgtacggttactacgggtggacgtgggtacggggtacgacggggtaacacgtttacctaccgtaccttcgtactacttacgtacgttacggacgtaaggtaccggtacggacgttaccgtaaggtacgttacgttcgtaacgttagttacgttaattacgtcgtaccgtagtacgtagttacggttacgttacttaccgtaccttcgttacggtaccggttacgggaaccgtaaacgggtaacggtaaacgggtaagtaacggttaaacggtaaacgtcggttacggtacggtccgttaacgacccgtaacttcgtccgttaccg

SEQ ID NO: 145654 - DNA, 544 bp, Homo sapiens
  misc_feature: GYAE6OF01EDZ9Y.21.4.A04.1.454.CMB.1.raw
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (452)..(452): a, c, t, g, unknown or other
  misc_feature (452)..(452): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (539)..(539): a, c, t, g, unknown or other
  misc_feature (539)..(539): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacgttggtccagccgtgggacgggtccctgagactctcctgtgcagcctctgctattccaccttcagtcgaacccacaacatgggactcggggtcccgccgaggcctaccggaggggaacgggctgggaggtggggtcggccgtataacgaaaggaanctaaanagttacagtaacagaatacgggcngtctgtagaaaggtagtcacatctanaaagngatagatacaaagacctnactgtaatcagacaatgaacagacctaagaaaccggaccacggctagtattagtggagtanaagaaagngtgagtggtggtagtagntgacg

SEQ ID NO: 145655 - DNA, 752 bp, Homo sapiens
  misc_feature: GYAE6OF01BFAS2.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccacggagaaattgtgttgacgcagtctccaggcctacctgttcttgctccgagggaagcgccacctctcctgccacgcctaccacgaccaagaactactccagacgtctactacgatacgccgttacggtaccagacaggaacgccgtacggccgacggtcctccgtacggttccacgtactactacgtacgccgttcgggtaccctacggacgggtaccacgtcggacctactcccgacgtacgtacggtcgaggtcggacgtagggtcgggtcgtacggggtaaccacggttaccttcgtaacctcgtaacctagtactagttacgtacgacggtactacgggtactaccggttaacgtaagttacggtttacgtaaccgtaggtttacggtttaacttaacggtcgtttaacacggtaacgtaacggttaagtacgggttaaccttaacgttaccgtttcggttaccggtacccgggtttacggaaccgggttaaacgggtaaaccgggtaaaagggttaacgtaaagggttaaaccggtaaaacggtaccggttaacgggttacggtacggtacgtaaccccggttaacgttaccggtccgtttaccgg

SEQ ID NO: 145656 - DNA, 634 bp, Homo sapiens
  misc_feature: GYAE6OF01B7TC0.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcacgcttctcttcctcctgctactctggctcccaggctcagaaaccaccggagaaattgtgttgacgcagtctccgaggcaccctgtctttgtctccgaggggaaancgccaccctctcctgcagctccagccaagaatactccagacgctaactacatacgcctacggtaaccagcagaacgcctggccaggcctcccgtaggttccctcattctatcgccgtcgggtccccacgacgggccctaacgtggcctaacgtccccgagtaccgtggttacgagtcggcgaggttcgggtctgggaactacggtacctttcacttctcactacgtagttacgacacgtacgtgggactcgtagaacgttgttccgatagtttacgttacttacgttggtaccaggtacttaaggtacgtaggttaacgttccaccgttcgtacggttccggtaccggaacgtaaacgggaaccgtaaagggtaacgtaaagtacggtaaacgtacgtcgggaggtcgtacgaccgtaacctgtcgttacg

SEQ ID NO: 145657 - DNA, 811 bp, Homo sapiens
  misc_feature: GYAE6OF01CKUJY.21.4.A04.1.454.CMB.1.raw
  modified_base (139)..(139): a, c, t, g, unknown or other
  misc_feature (139)..(139): n is a, c, g, or t
tcagtcgtcgctcgcacgaccggtgctcgatttagagtagtgatcagggggagctctgagagcggacgccccagccccagaattcccaggttgttttcatttggtgatcagcactgaacacagaggactcaccagtggngtttgggctggagtcgttgggttttccttgttgttattttacaaggtgtccagtgtgaggtgcagcgtggtggagtcggtgggggatacgttggtccaggtccgtgggacgggtccctaggacgtacctcgtccgtgtcgactacggtcctcgtcgctacgttcctaccttcgagtaccgaacccacgaacgtcggttcgggaaccggttcggggtaccccgaccggtaacgggacccgtaccggggaaagggggtacggggtcgttagggggtaacgggttcgggggtacccgggtaaccgttaaagttaaaccggaaagggtaaaccgtaaccgttaaaacgtaggtttaaacccgaaggttaaccgaaaggtaaaccggtaccgggtacgtaccggttacggtaagggtaacgggtaaaacggggttaccggttaccctaaccggtaagttacccgtaacggtaaaagtacggtaagttaacggtaacttaaaccgtaaaacgtaccttaacgtaacgttaaggttacacgttaacggaaacgtaatacggaacgtaccgtaacgtaaacggaaacgacggacgtacggttcgttaagtacgtttaggaggtaacgtaaggaaacgtaaggtgtaggtacgtggttaacgggtgaacgtgtacgtaacg

SEQ ID NO: 145658 - DNA, 685 bp, Homo sapiens
  misc_feature: GYAE6OF01BOZIM.21.4.A04.1.454.CMB.1.raw
tcagtcgtcgctcgcacgaccggtgctcgatttagagtagtgatcagggggagagctgctcagttaggacccagagggaaccagtggaaaccccagcgcagcttctcttcctcctgctactctggctcccaggctcagaaaccaccggagaaattgtgttgacgcagtctcaggcaccctgtctttgctccgaaggggaaacgacgccaccctctcctgcagctccagccagaatatccagacgctactacatacgccttaggtaccagcaagaagccctgggcctacggcctcccgtaagggttccctcacttctacgtcgccggttcgggtaccccagacgggacctaacggtcggcctactacccgaggaccgttacggttccaagggttcgggaccgtagggttcggggtacgttagggggaacctacggtaccgtttacgacgttcctacgtacttacgtagtttaacgcgtaacggtacggtacgggactaccggttaaggtaaacgttacgtttccgagtaacgttgttaccttacgtgtaccagtactaggttagaggtacgtttcaccgttgttccgttccggttacggaccggtaaacggggtaaccgtaaagggtaacgtaaaggtacggaaaacggtaacgttggacggtcttagaccctactagttcttacg

SEQ ID NO: 145659 - DNA, 866 bp, Homo sapiens
  misc_feature: GYAE6OF01ENKPD.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaancgccaccctctcctgcagcctccagccagaatactccgagacgcttactaacatacgccgttaggtaacccaggtaccaaggtaaccgcccgttacggggacccctaacggggccccttcccccgtaagggttttcccctacgtaacgtttcccgttaagtccggtaccggtttaccgggggttacccccaaacgggtaccggggtaccccctaacggttacggggaccctaaccgttaccccgaaaggtacccgtaaacgggttttccaaacggggttcggggaaccgttacggggtttacgggggttcccgttaaggggggaaccctaacgggttaccctttaccgaaacccgttttcctaaccgtaacgttaaccgtaacgttttaacggaccggtaacggtaaccggttacgggtaaaccgtacccgttaaggtaaacggttaccgtttttaccggaacggttacgtttacggttaacgtttaacgttacgttacgtaacgtacgtaacgttaacggtagggttaaccgtttacctaccgtttaccgttacggttaccggttaccgggtaacccggtaaacgggtaaacccgtaaagggttaacgaaagttaacggtaaaacgttacgttaggtacggtacgtacgacctaactcgttctacg

SEQ ID NO: 145660 - DNA, 700 bp, Homo sapiens
  misc_feature: GYAE6OF01ATC1G.21.4.A04.1.454.CMB.1.raw
  modified_base (216)..(216): a, c, t, g, unknown or other
  misc_feature (216)..(216): n is a, c, g, or t
  modified_base (319)..(319): a, c, t, g, unknown or other
  misc_feature (319)..(319): n is a, c, g, or t
  modified_base (563)..(563): a, c, t, g, unknown or other
  misc_feature (563)..(563): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccaggccgtgggacgggtccctggagaccttctcctgtgcagtcctctgcctattccaccttcgagtcgaccaacaacagtggacgtgggtcccnccgaggctaccggaggggaacgggcgtagggaggttcggggtcggaccggttaattaacgaaaggaaacgtactaaacgtaagttaacaaggtaacaaggtaacgtaccgggcgtcggttacgtaggtaaggaaacgggtagttacccaactagtacctaacgaaaggtagtaagtagtaacttaacgaaaacgtaacctactaacgttagttaacttcgtaggtaactaaaagtacgtaaacncggtaaccctaacgggaaaacccgcggaaccgaccgggtaccgttagttaacgttacggttaggtagggtaaacaaaggtaaaacgggtggttaacgggtagttgggttacggggttagtacggtcgtaggttaacg

SEQ ID NO: 145661 - DNA, 566 bp, Homo sapiens
  misc_feature: GYAE6OF01EQ8WQ.21.4.A04.1.454.CMB.1.raw
  modified_base (199)..(199): a, c, t, g, unknown or other
  misc_feature (199)..(199): n is a, c, g, or t
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggcctcccaggttccctcatctatcgcgtcgggtcccacgacgggccacgtggccactcccgagactaggttccagtggcaggtggtcgnggacagtcttcactcncatcattagcagtacgtggacgccgtagtaacgtagtttcgactagttcgtattacgtcgtacgagtagttagtagttgggtacgtccgtaccgtactaccgttggaccgtagggtaccgaagggtcggaacgtagtacgaacggaacgtaacgttggtacggtctaggaccctaacgtgttaccgg

SEQ ID NO: 145662 - DNA, 569 bp, Homo sapiens
  misc_feature: GYAE6OF01C4VP1.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcaccctgtctttgtctccaggggaangccaccctctcctgcagctccagccagaatactccagagactactacatagcctggtaccagcagaacgcctggccaggcctcccgaggttcctcatctatcgcgtcgggtcccacgcgggccacgtggccactcccagacaggttcaggtggctaggtgggtactggggacaggtacttcgactctacatctacgttgactagactcgggagtcctagaacgttattcgactagtagttatttacgtgtacagtactagtaagtggtaacgttcaccttctgtccgttcggacgaacgggtacctaaggtaacgtaaatacggaaaccgagttacggtggtaccgttacgcctaaccgtgttccgttacg

SEQ ID NO: 145663 - DNA, 820 bp, Homo sapiens
  misc_feature: GYAE6OF01AF14W.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccagaaaccaccggagagattgtgttgacgcagtctccagcaccctgtctttgtctccaggggacagacgccaccctctcctgcggggccagtacaaattcgttacccgcgactacttagcctggtaccagcagaacctggccaggcctcccagacctcctcactccaacaatatacttctacgacgggcccgcgggcactacccgagacctagggttcaaggttggacgtaggtgggtccgtacgggactagtacttcctaacctccgttacccacctaacgtccgtaaggacccaagggtaccttacggggaccgtacccgttaggtaaacgttacgtttttacgaccgttaaatttagggttaactttaacgttacggttacgtaacggttaacttaaacgttacgttaccggtacccctaaccccgtaaacccccccgtacgtttaccccgtaaccccggttttacccgggaaacccggttaaaacccgggggtaaccctaaacccgggttaacccttaccgggaaacccggtaaacggttaacgttaaaaccgggtaaaacccggttaaaccgggttaccgggttaccgggtaccgttaccggtaacccctaaacccgttacgtttacccgtttacccgggtttacccttttaccccgttaaccgtttccccggttttaacccccccgg

SEQ ID NO: 145664 - DNA, 766 bp, Homo sapiens
  misc_feature: GYAE6OF01EVAZU.21.4.A04.1.454.CMB.1.raw
  modified_base (168)..(168): a, c, t, g, unknown or other
  misc_feature (168)..(168): n is a, c, g, or t
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtcncaggcaccctgtctttgtctcgaaggggaancgccacctctctgcagctccagaccaagaactactaccgagacgactactaacgatacgccgtaggtaaccaggaccaaggaacgccgtacggaccgtaacggtccctaccccggtaacggtttccctactacgttaccgttaagtccggtaccggttcccgggtaccccgaacggaccggggtaccccaacggttcggaccctaccgtacccgaagtaccgtacggttacgagggtcggacgtagggttcgggtacgtacgggaactaacggttacctttacgtaccgttactacgtaacgttaccttaaggtttaacgacggtaggtacggtacggtacgtaccgttaaggtaaacgttcgtttacggacgttaaggttcgttaactttacgtacggtacgtacggtaacgtaagtaaggttacggttaacgtttacttaccgttcggttcggttaaccgggtaccggtaaccgtaaacggggtaaaccgtaaaggttaaacgtaacgtaacgggtaaaaccgtacggttgaaccgggtctacggaaccacgttacgttgtaccg

SEQ ID NO: 145665 - DNA, 726 bp, Homo sapiens
  misc_feature: GYAE6OF01EXXUN.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcacctgtctttgtctcgaggggaancgccacctctcctagcagcctaccagccaagtaatactccagacgctactacatacgcctggtaccagcaagacgcctggaccgaggtccctccgtacggtttccctcactcttagtcggtccgttccgggtacccaacggcgggcccaacggtcggaccctaacgtccccgaagaccgtacggttaccaggttcggacgtagggttcgggtacggtagggactacggtaccttacgacttcgtactacgtcgtaagttacgacgtacgtacgtacggaacgtacgtaaggtaacgttacgttacggtacgttaaggtttacgtttaacgtttacgttacggttacgtaacgtacgttaagttacgtttacgggttaacgttacccttaccgttacggttacggttcccgggttaccggtaaccggttaaacgggaacccgttaaagggttaaacgtaaacggttaaacggtaaaccggtacgttacgggtacggtaccgtacgaacccgtacgttacgttcgttaccg

SEQ ID NO: 145666 - DNA, 895 bp, Homo sapiens
  misc_feature: GYAE6OF01B8G0N.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttggttttccttgttgttattttacaaggtgtccagtgtgaggtgcagcgtggtggaggtcggtgggggtacgtacgttggtaccgagccgtgggacggtccctgacgtactctccgtgtgcacgcctcgtgctacttcctaccttcgacgtacgaaccaacaacagtacggtaccgtcgggtcccgaccgacgggccgtaccggaagggggaacgggtccgtaggggtacgggttcggggtccggtacccgttaagttaacggaaaggaacgtacgtaaacgtaacggttaacaacggttaaaccaaggtaaccgtaccgggtacccggtacggttacgttaagggtaacgggtaaaaacggggttaaccggtttaccctaaacccgtaagtttacccgtaaacgtaaacgggtaacgtaattaacgggtaaactttaaacccggaaaaacgttaaacccttaaccgtaaccgtttaagttaacgttacccgttaagaaccgttaaaacgaacggtaaacccgaacggttaaccccgtaaaaccggaaaaacccgggttacgggaaacccgttaaccccggggtacgttttaaacggtttacgttttaaacgggtttacgggttaaacgggtaaaaccggaaaaacggttaaaaaaggggttcggggtttaaaagggttaacggtttacgggggttaacggggtttaaacggtaacggtttcccgggttagggtttaaaccccgg

SEQ ID NO: 145667 - DNA, 710 bp, Homo sapiens
  misc_feature: GYAE6OF01CXI55.21.4.A04.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (502)..(502): a, c, t, g, unknown or other
  misc_feature (502)..(502): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtcctccaggcaccctgttctttgtctccgaggggaaancgccctaccctctcccgtgccagcctccagccaagaatacnccagagctaactacatagcctaggtaccagcaagacgcctggccaggcctccccgtaggttcccacgacttctagtcgccgtcgggtccccacgacgggccctacgtcggccaacgtccccgaggtaccgtacggttaccgaggtcggacgtaggggttcgggttccgaggggtaaccacgggttaccttcgtaccttcgtactacttcgtaagttacgacgtaagaccgttaggaacgtccgtagacgttacgttcgntaagttgtttactttacgtgttaccgacggttacgtagttagttacggtaacgtttcctaaccgtttcggttaccggttaccgggtttacccgggaaccggtaaacgggtaacccggtaaagggttaaacgaaacgttaaacgggaaaccgttaacggttcgggtacggtaccttaccggtaccctaacccgtagtttccgttaccgg

SEQ ID NO: 145668 - DNA, 926 bp, Homo sapiens
  misc_feature: GYAE6OF01A47OQ.21.4.A04.1.454.CMB.1.raw
  modified_base (874)..(874): a, c, t, g, unknown or other
  misc_feature (874)..(874): n is a, c, g, or t
tcagtcgtcgctcgcacgaccggtgctcgatttagagtagtgatcagggggagagctgctcagttaggacccaggagggaaccatcggaaaccccagcgcagcttctcttcctcctgctactctggcctcccgaggctacaacgaacccaccggagtaattggtgttgacgcacgttcctccgacggcctacccgttgttccgtttcggtccgtaccgggaagggggaaacgccggtacccctaccccgttccttacccgtgccgtacggtcctaccgacgtacccgaagtaactaccgtaccgaagtacgtaccttaactacgtactaccgtccgttacggtaacacgacgtaacggaaccggtcccgtacgggacccgtacggtaccccgttaccccgtaacggtttcccctacgtacttaccgtacggtccggtaccggtccgggaccccaacgggtaccgggacctacggaccggtaccctaccgtcccgaagtccggttacggttacggacgggtcgtaccggtacgggtcggggttaccgacgggtaactaccggttaacctaccctacgttcctacggttacttacgtaacggttacggaacgtaccgggtacggtacggtaacggtccggttaaacggttaaccggtttaccgttaacggggtacctttaagggtttaacccgtacggtttttacccgacgggttaactaagggttaccgttaaaggtttccgggtaacggtttaaccgtccctttaaccggtttcgggttaccgggttaccgtaacccggggtaaccgtaaacgggttaacccggtaaaagggtaaaccgtaaacgggttaaacccgggtaacgttaaccggggnggttacccgggttaaccgtacgaaacccgttaccggttacttcccgggttac

SEQ ID NO: 145669 - DNA, 801 bp, Homo sapiens
  misc_feature: GYAE6OF01D3P5Y.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaattgtgttgacgcagtctccaggccaccctgtctttgtctccgaggggaancgcccaccctctcctgcagcctccagccaagaatactccagagctactacatacgcctaggtaccagacaaggaacgccgtgggacccacgggtccctaccccggtacggtttccctactacttccttagtccggtccggttaccggggtaccccaacgggaccggggtcccctacggttcgggacctaaccgtaccccgaaggtaaccgtacggtttaccgaagggttcgggacgtacggggtttcggggtaccgtacgggggaactaacggttacctttaccgaacccgttccttaaccgtaacttaccgtaacgtttaaccggaccgtaacggtaaccggttcggggtaaacctacccggtttaagggtaaacgtttacccgttttacccggaagtttaacgggtttacgtttaactttacggttacgttaaccgtaggtaccgttaaggttaacgtacggggttaaccttccgtaccgttacgttcgggttaccggttaccgggaaccgtaaacggggtaactaaagggtaacgtaaaggttacggtaaacccggtagttgggtacgtactaccgaacctaccgtgtttcgttaccg

SEQ ID NO: 145670 - DNA, 776 bp, Homo sapiens
  misc_feature: GYAE6OF01A39C1.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccacggagtaaattgtgttgacgcagtctccaggcctaccctgttctttcgtctaccgaagggggaaacgacgcccacccttctccgtcgcacgcctccgacgccaagtaacttacaccgaagacgtactaaccgtactaacgtaccgtccgtacggtaccgaagaccgaaggaaccgtccgtacgggacccgacgggtccccttaccccgtacggtttccctacgtacgttacctcgttcggtccggttcccgggtacccacggtaccgggcccgtagtccgggtacctaacctacccggacgtaacggtaccggttacgagggtcggacgtagggtcggttacgcggactacgtaccttcgacgtctactactacgtacgttacggacgtaacggtcggtacggtaccgtacgtaaggtaacgttcgtttcgtacgttacggttacttacgttaccgtagtacctacgcgttaagttcgtaacggttacttccgtaccgttcggttaccggtcggttaccggaaccggttaaacggtaaccggtaaacggttaacggtaaacgtaacgggtaaaccgtacgttaacgggacgttacccggtactaccgtaccgttacggttcgtttaacccgg

SEQ ID NO: 145671 - DNA, 686 bp, Homo sapiens
  misc_feature: GYAE6OF01BYNLG.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaattgtgttgacgcagtctccaggcaccctgtctttgtctaccgaaggggaaagcgcccaccctctcctgcacgcctccagccaagtaatactccagacgtcctaactacatacgcctaggtaaccagcaagaacgccgtaggcccaggcctcccgtaggttccctacattctatcggccgtcggtacccagacgggcctacgtcgacctacgtaccagtacgtacggttcgtaggtcggagtcgggtcgggttcgtacggactacgtacttcgacctcgtactatactattacgacgacgtacgaggtacgaccgtagtaacgttacttcgacgtacgttagttactttaccgtagtaccgtaagtcgttaacggttaacgtacgggttaaccgttaccttaccggttccgttacggttacccggttaccgggtaaccggtaacgggaaacccgtaaaagggtaacgtaaaacgtaacggtaaaaccggtaacgttacggtacggtcgtacgtaacctaccgttagttccgttaccg

SEQ ID NO: 145672 - DNA, 711 bp, Homo sapiens
  misc_feature: GYAE6OF01AQE3Q.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaancgccaccctctcctgcagctccagccagaatatccagagctactacatagcctggtaccagcagacgcctggccaggcctccaggttcctcatctatgcgtcgggtcccacgacgggcccagtcggcactcccgagactaggttcaggtggctaggtcggggtctacggggactacgtactttaccgacttccgtacaactcgtaacgttacgaccgtaacggtaccgttacggaacgtccgtaaggtaacgttacgttttaccggacggttaacggtttacggttaacgtttaacgttaggttaccgtaacggtaccgtaaggttaacggttacggggttaaaccgtttcccgtaaccgtttccggttacgggtttcccgggttaccgggttaacccggaaaacggggtaacccggtaaaacggggttaaacgtaaacggtaacggtaaaaacggtaccggttacgggttacggtacgttacggaccctaaccgtcgtttccgttaccgg

SEQ ID NO: 145673 - DNA, 721 bp, Homo sapiens
  misc_feature: GYAE6OF01BC0TC.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgtctccgaggggaaagacgccaccctctcctgcagctccagccagaatactccagtacgacttactacaatacgcctaggtaacccagaccaagaacgccgtaggcccaagggtcccttccccgtaggttccctacgtacttcctaagtcggccggttacgggtaccccaacggtaaccgggcccctaacgtcgggtacccaaccgttacccgaaggtacctagggtttaccgagggtacggaccgtaagggttcggggtctacggggaactaacggtacctttaccgactttcgtacactacgtacgttacgacgtagacgtaggtaacgtacttaaggaacttacgttacgtacgtagttagttaacgttacgtgtaccgtagtcgtaagttacgtagggtaacttaccgtacgttaccgttacggttaccggtaaccggtaccggtaaacgggtaaaccgtaagggtaaagtaaacggttaaggtaaaaccggtagttaggaccggtacgtacgaccgtaacgtcgtacgttacg

SEQ ID NO: 145674 - DNA, 762 bp, Homo sapiens
  misc_feature: GYAE6OF01C3Q8F.21.4.A04.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctccaggctcaagaaaccaccggagaaattgtgttgacgcagtctccaggccacctgttctttgtctccgaaggggaaanacgcccacctctcctgacacgcctccgacgccaagtaaatactaccaagacgctaactacatacgcctcggtaccacgacaacgaacgccgtcggaccgacggtcctccccgtacggtttcctacgtacttctacgtcgccgttcgggtacccaacggacggggaccctaacgtcgggaccaccgtacccgagaacgtcggttacgaggtcgggcaggggttcgggtacgtaggggaactacggttacctttccaccgtttcctacgtaacttacctaacgttacgaccgtaacggtacgtacggtacgacgtaagtaacgttagttacgtacgttagttacgtttaactttacgtagttaccgtaacggtacgttaagttaacggttagggttaaccgtttaaccgtaccgtttaccggtttcgggttaccggttacccgggaacccggtaaaccggggtaaacgtaaacggggttaaaacgtaaaggtaaacgggtaaaaccggtaccggttaggtacggtacgttaacccgtacgaaccttacgttcgtttaccg

SEQ ID NO: 145675 - DNA, 750 bp, Homo sapiens
  misc_feature: GYAE6OF01CUAOU.21.4.A04.1.454.CMB.1.raw
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (453)..(453): a, c, t, g, unknown or other
  misc_feature (453)..(453): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcaagaaaccaccggaagaaattgtgttgacgcagtctccaggccaccttgttctttgtctaccggaagggaatctacccacctctccngcacgcctaccgacgaccaagaatacnccgaagacgtacttactanactaacgtccgtaggacagacgaagacgtccgtacgaccgagcccttaccgtagtttaccactacttacgtagtccgtcgtaccgggtaccaacggccggacctacgcggtacaccgtaccgaagtacgtacgtcgaggtcggactagggtacgtcggacggactacggttcctacacgttacctanactacgtaagttacgacggtacgtacgtaggtaacgtaccgttaaggtaacgttacgtttacgtacgtaagtttacgtttaacttaccggtgtaccgaagttaccgtaaggttacgttaacgggtacgttacccttaacggttaccggttacggttaaccggtaccgggtaaaccggtaaaacgggtaacccggttaaaagggtaaacgtaaaacgggttaaccgggtaaaacgttacggtacgggtttaaccggaccgttaacgacccggtttaactacgtttcggtttaaccccg

SEQ ID NO: 145676 - DNA, 610 bp, Homo sapiens
  misc_feature: GYAE6OF01BI4YK.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaancgccaccctctcctgcagcctccagccagaactactccaagcgccttaactacagtacgccttaggtaaccagccaagaacgccgtggcccagggtcctccccgtaggtttccctacagttctagtcgcgttcgggtacccagacgggccagtcggccacgtcccgagaccgtaggttcaggtcggacgtagggtcgggtcgtagggactacggtacttcgacctctacatctagttacgcagtacgtggacgcgtagaacgtcttcgatagttgtacttcgtgtacagtacgtagttacgtaggtacgttcctaccgttcgttcgtaccggtcggaccgtaacggacgtaaaggtacgtaaagtacggaaacgtacgttggtacgtacgtacgaccgtactgttcgttacg

SEQ ID NO: 145677 - DNA, 772 bp, Homo sapiens
  misc_feature: GYAE6OF01C46ZS.21.4.A04.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagagtagtgatcaggggagctctgagagcggagccccagccccagaattcccaggttgttttcatttggtgatcagcactagaacacagaggactcaccatggagtttgggctgagcttgggttttccttgttgttatttacaaggtgtcagtgtgaggtgcagcgtggtggagtcgtgggggatacgttggtccagccgtgggacgggtccctaggacgtacctctccgtgtcgcacgcctctgctactctaccttcgacgtcgaaccacaacncgtacggaccgtcgggtcccgccgtaggccgtaccggaggggaacggggctgggacgggttcggggtcggacccgttaagttacggaaaaggtaacgcttaaaacgagtttaacgaagtaaacgacgtaaataccgggacgtcggttacgtagtaagggtaaacggtcggttacccaacctagttacccgtaaagaaggaagtagtaacgtaacgttaaacaaacgttaaccgtctaacgttagtactacgtacgtaaacgtaaaagccgaaaaccgtacgtaacccgtaaaggtaaaacccccgggagggtaacccgtaacccgggttaccggttttaacgttaagtttaaaccggttcgggttaaaacgggtaaagtaaaaaccgggtaaaaaggggttgtaacggggttaacgtttggggttaaggggtaccgggttaacgtcgggtttaaggtaaccggg

SEQ ID NO: 145678 - DNA, 814 bp, Homo sapiens
  misc_feature: GYAE6OF01B3YXH.21.4.A04.1.454.CMB.1.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
  modified_base (416)..(416): a, c, t, g, unknown or other
  misc_feature (416)..(416): n is a, c, g, or t
tcagtcgtcgctcgcacgaccggtgctcgatttagagtagtgatcagggggagagctgctcagttaggacccagagggaaccatggaaaccccagcgcagcttcctcttcctcctgctactctggcctcccaggcctcaacgaaacccgaccggagtaaattggtgttagaccgctacgtctccaggcctacccgttgttcctttgcctaccggaaggggaaacnccgccctacccctctcccnggacacgtcctccgacgaccaagaacttacaccaggactactactanacgtcgtccgtacgaccagacgaagacgccgtacggaccgacggtccctacccggtaggttccctactagtacttacgtcggtccgtacccggtaccaacggtaccgggccctacgtcggtaccncctaacccgagtacgtacggttcgaacgggtcgggtagtacggggtcgggtacgtacgggtaaccgtacgttaccctttcgaaccccgtttagaccctttaacgttaaccgttaacgttaacccggtacgtaccgggttaccggttacccgggaacgttaaccggtacgggtaaaccgtttcgttaacccggtagttaacggtttacgttaacgtttaccgtacggttacgaagtttaccgtaaggttacggtacggtttaaccgtaccgttccgtttaccggtacgttaacccgggtacggtaaccgggtaaaccgggtaacggtaaacggaacggttaaacgtaccggtaacggtaacgttcgggacgttccgtacgtacacgttcgtcggttacg

SEQ ID NO: 145679 - DNA, 816 bp, Homo sapiens
  misc_feature: GYAE6OF01CXIC2.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgttctttgtctccgaaggggaagacgcccaccctctcctgcacgcctaccaggaccaagtaactactccaaggacgtacctaactaacatacgtccttacgggtaaccaacgaccaaggaaacgcccgtcgggacccgaacgggtccctaccccgtaacgggtttccctacgaacttccgttaagtcggtccgttccggggtaccccaacggaccggggaccctaccggttacgggcctaaccgtacccccgaaggtaccgtacgggtttaccaggggttacgggacgtacgggtttcgggtacgtagggggaacctacggttacctttaccgtaccgttcgtactaacttaccgttaacgttacggtaccgtaacggtacgggtaggtaaccgtacgttaagggtaaagttactttcggacgttagtttacgttaacgtttacgtgttacgaacggtctaaggttagttacgggttaacttaccgttaccgtttcggttacggttcccgggttaaccggtaaccggtaaacgggtaaacccgtaaagggttaaacggtaaaacgttaaccgggaaaaacgttacggtacgggtacgtaccgttaacgggaccctaacgttggtttcgttacccgg

SEQ ID NO: 145680 - DNA, 867 bp, Homo sapiens
  misc_feature: GYAE6OF01EU60Y.21.4.A04.1.454.CMB.1.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
  modified_base (856)..(856): a, c, t, g, unknown or other
  misc_feature (856)..(856): n is a, c, g, or t
tcagtcgtcgctcgcacgaccggtgctcgatttagagtagtgatcaggggagagctgctcagttaggacccagagggaaccagtggaaaccccagcgcagctttctcttcctcctgcttactctggcctcccgaggctcgaacgaaacccgacggagtaaattgtgttgacgcagtcctccgagtcctacccttgttctttcgctacggaaggggtaaacncgtccctaccctcgtccgtgccgtagccctaccacggacctaagaacttaccncccgaaggaccgtcctttaaccgtaacaagttaccggtcccgttaacggaacccaacgtacgtaaacgaacggttcccggacggacccgtacggtacccccttacccggttacgggtttacccctagactttaccgttacggccggtcccggtttcccggggaccccaaggggaccgggtaccctaacggtcgtaccttaaccccggtacccgaacggtacgttacgggttaccagggtcggtacggttagggttccggtacgtaggaaccctcgggttaccttacacctttcctaacgacgtttacgtaagttcgaacgttacggtaccggtacggtaaccgtacggttaaggtaaaccgtttcgttaccgtaccggttaagtttacgttacttaaccggttgtacgtagtaacgtttaacggttagttacccgggttacgtttaccgaccgtttggtaccggttacccggttaacgggaaccttaaaccggggtaaacgttaaggtaaaccggtaaccggtaaaggtaaaccccggtgtttcggggaaaccgtccgttaacggacccttttaaaccggtnttcccgttacg

SEQ ID NO: 145681 - DNA, 803 bp, Homo sapiens
  misc_feature: GYAE6OF01DUQMI.21.4.A04.1.454.CMB.1.raw
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctccaggctcaacgaaaccacgggtaataattgtgtcgacgctagtcctacgagcctaccgttgttcgttcgtccgaccggaaggggaacncctccctacccttctccgtgactacgcctaccgacgtacctaataactacnccgaaaggtactacctaactaactagaccgtaccgtacggtaaccgagacgaacgaaccgtcgtacggaccgacggtccctacccggttacgtttaccctacttaccgttacgttacgtcggtccggttacccgggtacccgaaccgggtacggtacccgtaacggtccgggacccttaaccgacccggtaaggtaaccggttacggttacgtacgggtcgggtaacggttacggggtccgggtaacgtacgggaacgttacgtaccttacgttaccttacgtacgtaacgttaaccgtactaacggtaccggtaacgttaacggtacgggtacgtacgttaacggttactttaccggtaggtacgttagtttacgttaaccttcgtaggttacaacggtagtaaggtacgttacgtacgttactcgttgtacggttaccgacggtacggaaacggtataaacgggtaacttaaggaacggttaaacggtacgttaccggacgtaccgtacgtaacctacggttacttccgtttaaccg

SEQ ID NO: 145682 - DNA, 844 bp, Homo sapiens
  misc_feature: GYAE6OF01BS3Y0.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctccaggctcagaaccacggagaaattgtgttgacgcagtctcgagcacctgtcttgctcgaggggaagcgccacctctccgtgcagcctccagaccaagaacttactacccgaggactacctaacctaacatacgtcctacggtaaccagacaacggaacgcccgtgggacccagggtccctacccggtacggtttccctacgtacttcgttacgtcggtaccggtttaccggggtacccccaacgggtaccgggtccccgtaacgttccgggaccctaaccgtacccccggtaaggtaaccgttaacggggtttccgaaacggggttcggggaaccggttagggggttttaccgggggttaccgtacggggggtaaaccctaacgggtttaaccccgttactaaacccggtttccttaccgtaagtttacctaacggttttaaccggaacgtaacgggtaacgttacgggtaaaccgtaccgttaacggtaagttacgtttaccgacgttacgtttacgttaacgtttacgtcgtacgtacgtacgttaacggttaagtaacggtaatttaccgtaccgttcggtttacgggttaccggttaaccgggtaaccggaaaccgggtaaccgtaaagggtaaacgtaaacgtaaccggtaaaacggtacggttacgggtaccggtacgttaacggaaccctcgttaacgttccggttaccg

SEQ ID NO: 145683 - DNA, 688 bp, Homo sapiens
  misc_feature: GYAE6OF01A4TKV.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaggggaaacngcccaccctctcctgcagcctccagccaagaactatccagacgctactacatacgcctggtaccagcaagaacgccgtaggccacggcctccccgaggttccctacagttctagtcgccgtcgggtcccaacggcgggcccacgtcggacctactcccgaagaccgtaggttcgaggtcggactagggtcgggtcacggggaactacggtacttcacgttctactactcgtattacgacgtacggtacgtaggacgtcgtagtaacgtacgtttccggacgtacggttagttaactttacgtcgtacgtagtacgtaagttaacggttaggtaacgttccgtaccgttcgtcggtttaccggttaccggtaccggtaaacgggtaacccggtaaagggtaaacgtaaaacggtaacggtaaaacccggtaacggttaggttaccgggtacgttaccggaaccctaacccgttacgttccgtttacg

SEQ ID NO: 145684 - DNA, 780 bp, Homo sapiens
  misc_feature: GYAE6OF01DPOR8.21.4.A04.1.454.CMB.1.raw
  modified_base (625)..(625): a, c, t, g, unknown or other
  misc_feature (625)..(625): n is a, c, g, or t
  modified_base (719)..(719): a, c, t, g, unknown or other
  misc_feature (719)..(719): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaccacggaagaattgtgttgacgcagtcctccgacggcctacccgttgttcgttttcgtccgtaccgggaaagggggaaacgaccgcccctaaccccgttcctcctcggaccacgtcctaccgacgaccaagtaattacacccgaaggtaccgtacttaacctactacgtaacgtcccgttacggaaccaggaacgaaggtaaccggccgtacggggacccgacggtcccttacccggtacgtttcctactacttacgtacggtcggccggtaccgggtacccaacggaccgggacctacgtcggacctaccgtaccgaacgtacggtcggtttacgacgggtaggacggttaggggttgggttaccggtagggaacctacgttaccttacaccgtttacgaactacgttactaacgttacgacgtaacgcggtaggtaccgtacgtaagtacgttcgttacggagttacgtagtttacttacggngtaagacgtagttaaggtacgttagtaccgtttcctacgtttcgggtcggttaccggtaccggaaccggaaaggggttaacaagggtttaaaanaaacggtacggtaaaacgtagggttgtacgggtactacgaccttaacggtcttcgttaccg

SEQ ID NO: 145685 - DNA, 819 bp, Homo sapiens
  misc_feature: GYAE6OF01CUJJZ.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaanacgccaccctctcctgcagcctccagccaagaatatccagacgctactacatacgcctggtaccagcagaacgcctggccaggcctcccgaggttcctcactctatcgcgtcgggtcccagacgggccctacgtcggctacgtccccgaagtaccgtggtttaccaggttgggacctagggttcggggtaccgtacggggaacctacgggttaaccctttcgaaacctttccgtactaacgttaccgtaaagtttaacgaccgtaacggtaccggttaacgggtaacgtacccgttagggtaaacggttacgttttaccggacgttaacggtttaggtttaacttttaccggttacggttaaccgtaacggttaccgttaaagggtttaacggttaacggggttaaaccgtttttcccgtaaaccccggttttcggtttaccgggtttaccgggttttaccccggggtaaccggttaaaaccggggggtaaacccgttaaaagggggtttaaaaccggtaaaacgtttaacgggaaaaaacccgggttaacccgttaggggttaaccgggtaccgttaccggtaacccgtaaacccgttaacgttccggtttaacccgg

SEQ ID NO: 145686 - DNA, 820 bp, Homo sapiens
  misc_feature: GYAE6OF01DFJ29.21.4.A04.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctgctcccaggctcaacgaaaccaccggagtaaattgtgttcgacgcacgtcctaccgnggccctacccttggttcctttttcgtcctaccggaagggggaaacgccgccctaaccccttctcccgtgcctacgcctccgaacgacccgaaataacttacctaccgaagacgtacctacctaacagttaccgtcccgtacggtaaccgagacgaacggacgtccgtacggacccgacggtcccctaccggtacggtttcccactacgttcgttacgtccggccggttcccgggtaccccaacgggtaccgggtccctaccggtacggaccctaaccgtacccggtaagtaccggtaaccggtttcgaacgggtttcgggacgttacggggggtttacgtaccggtacggggtaacctaacgttacccgtttaccaccgttactaccgtactacgttaagttaccgaacgtaaccggtacgtacgggtacctaacccggttaaggaaccgtttaccgtttacgacgttacggtttacgtttaccgtttaacggtccgtacgtaacgtacgttagttaacggtagtttaacctccgttacgtcgttacgggttacggccgtaaacgacggtaaacgtaggtaacctaaagtaacccggtaaagtacggttggaacgttccacggtaaccacgttcgtcggttcc

SEQ ID NO: 145687 - DNA, 710 bp, Homo sapiens
  misc_feature: GYAE6OF01B8FBW.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccaggggaanagccacctctcctgcagctccagccagaatactccagagcctactacattacgccctggtaccagccagaacgcctggccaggctcccaggttcctcattctatgctgggtcccacgacggccactggcactcccgagacgaggttcaggtggcgaggtcgggtcgtggggactagacctttcaccttctcgattacagtttacgactaggactgggacgtacccgtaggaacgttagtttcgacgtaaggttcgttaatttacgtcggttacaggtaccgtaaggttaacgttacgggttaaacgtttcctaaacccgtttcgttaccgggttaccgggtttcccgggtaaccccggtaaaacgggggtaaccccgtaaaacgggggtttaaaccggttaaaaaaggtttaaccgggtaaaaaaacccggttaaccgttaagggttaaccgggggttaccttaaccgggtaaccccgtaaacccctttaaggttacccggttttacccggg

SEQ ID NO: 145688 - DNA, 741 bp, Homo sapiens
  misc_feature: GYAE6OF01B49VQ.21.4.A04.1.454.CMB.1.raw
  modified_base (278)..(278): a, c, t, g, unknown or other
  misc_feature (278)..(278): n is a, c, g, or t
  modified_base (727)..(727): a, c, t, g, unknown or other
  misc_feature (727)..(727): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccagtggagtttgggctgagtcgttgggttttccttggttgtttattttacaaggtgtccagtgtgaggtgcagcgtggtggagtcggtgggggatcgttggtccaggccgtgggacgggtccctggagtactctcgtgtgcgacgtcctnacgctacttccaccttgacgtacgaccaagaacgtgtacggacgtcgggtcccgaccgaggccgtaccggaggggtaaggggcgtagggacgggtcgggtaccggtaccgttaagtaaacggaaaggtaaacgtacgttaaacgtaaggtttaaccaaggtaaccgtaaggtaacgttaccgggccgtaggttacgtaggtaaggaaaccgggtacgtaccgtaactagttaacgacgtaagacgtaagtacgaacgttaacgaaaacgtacgttaccgtaacgttagtaacttacgtaacgaaaccgttaaagaaccggaacgtaaccgaacccggtaaaacgaaacccggaacggtaccgaaccggttacgttacgttagttacgttagggtaacggttaaaggaaacgtaaaaggagggttagtaggtaggttacgggtaggttancggttagtaaccgg

SEQ ID NO: 145689 - DNA, 740 bp, Homo sapiens
  misc_feature: GYAE6OF01BUR52.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccacggagaattgtgttgacgcagtctcaggcacctgtctttgtctccgaggggaacncgccacctctcctgcagcctccgagccagaactctaccagacgcctactacagtacgccttaggtaccagacaaggtaacgcctacgggccaacgggtccctcccgtacggtttccctactacttcgttacgtcggtccggtccggggtacccgacggaccggggtaccctacggtcgggacaccgttcccgaaggtaccgtaggttccgaggtacgggcgtagggttgggtaccgtcggggaactacggtacctttcgaccgttctactactacgtaacgttacgacgtaacgtacggtcggtaacgttacggtaacgtaacggttacgtttacggtacgttaacgtttacgttaactttacgttacgttacgtacgtacgtaacggttagtacgggttaacgttaccgtaccgttcgttacgggttccggttaccgggaaccggtaaacgggtaaaccggttaaacgggtaagtaaacgtaacggtaaaaccggtacggttagggacggttacgtacggtaccacgttacgttccgttaccg

SEQ ID NO: 145690 - DNA, 728 bp, Homo sapiens
  misc_feature: GYAE6OF01D0A9I.21.4.A04.1.454.CMB.1.raw
  modified_base (718)..(718): a, c, t, g, unknown or other
  misc_feature (718)..(718): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggagggtcccctgagactctcctgtgcagcctctgcattccaccttcagtcgaccaacaacagtggacgtcgggtcccgccagggccctaccggaggggaacgggtcgtagggaggtcggggtccggaccgtaagttaacgaaggaaacgtccgtaaaacgagttaaccaaggtaaccaaggtaaacgtaccgggcgtaccggttacgtcggttaaagggaaaagggttaacgggtttacccaaacccgtaacttaccgtaaccgtaaaggtaagtaacgttaggtaaacttttaaccgaaaaacggtaaccttacccgtaacgttacgttaaacttaccgtacggttaaacaaaagtaccggtaaaacaaccggtacccgttaaagggaaaacccgggacgggaaccgaaccgggtaccgttagtaatttacggttagtagggtaacaacgtaaaggagtggtaagttggttaggttaggtacgngttggtaacg

SEQ ID NO: 145691 - DNA, 760 bp, Homo sapiens
  misc_feature: GYAE6OF01DMVFR.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcaccctgtctttgtctccgaggggaagatccaccctctcctgcagctccagccagatactccagacgctactacatagcctggtaccagacagaacgccgtggccaggcctcccgtggtttccctcacttctagtcgcgtcgggtcccacgacgggcccacgtcgggccactccccgaagtaccgtacgggtttcgaacggttgggaccgtaggggttcggggtccgttacgggggaacctaggtaaccctttccgtaaccgttcctacgtaacttacgaacgtttacgaccaacggtaacgtacggacgtaccggtaagtaacggttacgtttccgtacgtacgtttacgtttacgttttacgtcgttacgacgtaccgtaagttagttacgggtacggtttacccttaccgttccgtttacggttccggtttacccgggaacccgggtaaaaccggggttaaccgtaaaaacggggttaaacggtaaaaacggtttaaccgggtaaaaaaccggtaaccgggtttacgggttaccgggtaccggttaaccgtaacccgtaacccgtaggtttcccggtttaaccgg

SEQ ID NO: 145692 - DNA, 685 bp, Homo sapiens
  misc_feature: GYAE6OF01DZHSH.21.4.A04.1.454.CMB.1.raw
  modified_base (678)..(678): a, c, t, g, unknown or other
  misc_feature (678)..(678): n is a, c, g, or t
tcagtcgtcgctcgcacgaccggtgctcgatttagagtagtgatcaggggagctctgagagcggagccccagccccagaattcccaggttgttttcatttggtgatcagcactgaacacagaggactcaccatggagtttggctgagtcttgggttttccttgttgttattttacaaggtgtccagtgtgaggtgcagctggtggagtcggtggggatcgttggtccacgccgtggacgggtccctgacgtactctccgtgtcgcgacgtccctgtgacctacttcctaccttcagtacgaccaacaactagtcggacgtcgggccgccgaggtcccgtaccggtaagggacgggtcgtagggtacggttcgggtacccggaccgttaagtaaccgaaaagggaactaacgtaaacgtagttaaacgagttaaacgaacggtaaacgtacgggccgtacgttcgtaagggtaacggtaaaacggtacggttaccaacctacgtacgtaacgtaaaagtagtagtaagtaataacgtaaacgtaacctcgtaacgttcgtaatacctagaaccgtaaatacgaactaccgaaccgtaaacgaaaccggacgaccgacggtaccgtagtacgttagtaggttagaagaaacgaaggtagtaggagtacggtaggtagtgngtgtacg

SEQ ID NO: 145693 - DNA, 711 bp, Homo sapiens
  misc_feature: GYAE6OF01AIICE.21.4.A04.1.454.CMB.1.raw
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcctgtagttatttacaaggtgtcagtgtgaggtgcagcgtggtgggagtcggtagggggagtacgttgggtccaggccgtgggacgggtccctggagaccttctccgtgtgcacgccctcgtgactacttccaccttnacgtcaacccaanaaactgtggaccgtcgggccgcccgaggtccctacggaaggggtaacgggcgtgggacggtcgggtccgggaccgttaagttaaccgaaagggtaaacgacgtaaacgtaaggttaacacggttaaacgaagtaacgtaccgggacgtcgttacgtgggttaacgggaaaaacggttacggttaccaaccgtattacccgtaacgtaaaggaagtaagttacgtaaattaacgtaaaacgtactacgtacctagtaacgttcaagtaaccaaagttaacgaacgtacgtaccgaaagaaacccggtaggaccgtacggtcgtagttaaacgttacgttacggtaggtaaagaaacggaaaggtgtaagtacgggttaggttgggtaaggttcgtagtggtaaccg

SEQ ID NO: 145694 - DNA, 757 bp, Homo sapiens
  misc_feature: GYAE6OF01CR5XH.21.4.A04.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagagtagtgatcaggggagagctgctcagttaggacccagagggaaccatggaaaccccagcgcagctttctcttcctcctgctactctggcctcccaggcctcaacgaaaccaccgggaagtaaatttgtgttgacgcagtctccaggttaccctgtctttgcctcgaaggggaaancgcctaccctctcctgcagcctaccgagccaagtaactactaccgaaggacgtaccttaacctacattacggccgtacgggtaaccaagcgaaagaacgtccgtacggccgtacggccttacccggtacggttaccctcgtactacttaacgtcggtccgtaccgggtacccacggtacgggcctacgtcggactccgtaccgacgtacgtacggttcgaggtcggacgtaggtcgggttcgtacgggactacggtaccttacgtccttcgtacgtacttacgtaagtttacgacgtacggtaacgtcgggaacgtacgtaggtaacgtacgtttacgacgttacgttacgtttacttacgttacggtacgtacgtacgttaaggttacgtacggtttaaccgttacccgtaacgtttcgttacggttacccgggtaacggaccggttaaacgggaaccggtaagttaaacgtaacggtaacggaaaccgttacggttacgtacggtacgttacgacgtaacctttacggttccgtcgtttaaccg

SEQ ID NO: 145695 - DNA, 879 bp, Homo sapiens
  misc_feature: GYAE6OF01EZ9JA.21.4.A04.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctacaacgaaaccaccggagaaattgtgttgacgcagtctccaggccacccttgttcttgtctaccgaagggaaancgccctaccctctcctgacacgtcctccagaccaagtaaactactaccgagacgtaccttaactaccaagttaccgtccgtacggtaaccacggacgaacggaacgtccgtacggaccctacgggtccccttacccggttacggtttccctacacgtttcctacggttcggtacccggttccgggtaaccccgaacgggtacccgggtaccccgtaacggttccggaaccctaacccgtacccggaacggtaaccggttacggttacgaacggggtcggtaccggttaggggttcgggtaacggtacggggaaccttacgtaaccgttctaaccgttcgtactagttactaagtacgacgtacgtacgtcggtaacgtaccgtaagtaacgttcgttacgtacgttacggttaacttacgttacgttacggttacgaagtccggttaaaggttacggtttaagggtaccttttaccgtaccgttacgtttaccggggttaaccgttaaccccgggggtaaacggttaaaacccgggtaaaccgggtttaaaaggggtaaaacgttaaaacggggttaaacccgggttaaaaacgggtttaccggttaacgggtaacccggttacggttaaccccgaaaccctttaaccgggttacctttccgggtttaaccg

SEQ ID NO: 145696 - DNA, 630 bp, Homo sapiens
  misc_feature: GYAE6OF01A2CQT.21.4.A04.1.454.CMB.1.raw
  modified_base (529)..(529): a, c, t, g, unknown or other
  misc_feature (529)..(529): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccaggcctgggacgggtccctgagacctctcctgtgcagcctctgcattcaccttcagtcgaccacaacatggactcgggtccgccaggcctccgagggacgggctgggagtgggtcggcgtagttacgaaggaacgctaacgagttacagtaacagaatacgggcgcgtcgtggtaggaaagggtacggttacaacccgtattacctacgtaaaggacgaagttaggtaacttaccaaaaggtaacctctaaccgtgtactcgtagaactaaatcggaaaccaggtaccctaaggaaaacccggngggaacccacgggtccgtagttagttagttaggtacgggtaagaaactaaaagggtagtacgggtaagttcgggttaggggtagggtagtcggttggtacg

SEQ ID NO: 145697 - DNA, 789 bp, Homo sapiens
  misc_feature: GYAE6OF01EHHEY.21.4.A04.1.454.CMB.1.raw
  modified_base (211)..(211): a, c, t, g, unknown or other
  misc_feature (211)..(211): n is a, c, g, or t
  modified_base (775)..(775): a, c, t, g, unknown or other
  misc_feature (775)..(775): n is a, c, g, or t
tcagtcgtcgctcgcacgaccggtgctcgatttagagtagtgatcagggggagagctgctcagttaggacccagagggaaccatcggaaaccccagcgcagcttctcttcctctgctactctggctcccaggctacaacgaaaccacggagtaaattgtgttgacgcacgtctcgaggcctacctgttcttgtctaccggaaggggaaacncgcctacccgttctccgtcgctacgtcctaccgacgaccaagtaactacgtaccgagtacgtacttaactactacgtacggtccgtacggtaaccagacgaaggaaccgtccgtacggacccgtacggtaccttaccccggtacggtttccctacgtacttaccgttacgttccggtaccggttacccgggtacccgacgggaccggtaccctacggttcggacctaccgtaccgaacggtaccgttacggtcgagggtcggacgtacgggtcgggtacgtacggacgtacgtcgttacgacttctactacgtacgtagtacgagtacgtcgtacggacgtacgtagtaacgtttcgttacgacgttaggttacgttacgttacgtacggacgtaaggtaccgttaaggttacggtaacggttaccttacccgtcgtttccgggttacgggttaccccggtaacgggaaaccggttaaaccgggtaaacggtaaagggttaaaaccgtaaggtaaacgggtaaaccggtacgggttgtaccggtactaccgtacctaacggttnttccgggtttaacc

SEQ ID NO: 145698 - DNA, 826 bp, Homo sapiens
  misc_feature: GYAE6OF01C9D9H.21.4.A04.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcaacgaaaccacggagaaattgtgttgacgcagtctccaggcctaccctgttctttgctcgaggggaaancgccacctctctgcacgccaccacgacctaagaacttacnccgaagacgtactactaacatacgcctacggaccagacaagacgccgtcggccgacggtccctaccggtacggtttcccacctaacgttcgttacgtccggtccggtacccggggttaccccaacgggaccgggtaccccgtaacggttccgggaccctaaccgtacccggaaacggtaccggtacggttccggaaggttcgggacgtaggggtcgggttcggaacggaacgtacgttaccttacaccgtacttacgtattacgtaacgttaggaaccgtagggtaaccgttagggtaccgttaacggtaacgttaaacggttcgttaacgtacgttacggtttacgttacgtttaacccgttggtacgtaaccggttacgtaagggtttacggtaacgggttaaaccgtttacccggttacccgtttaccggttaccgggttacccggggtttaacccgggaaacccgggtaaaacggggtaaccgtaaaaacggggtttaacgaaaacggttaacgggtaaaacccgttaccgggtaggttaccggtacccgtaacgtaccctaaacgttgtcggtttaccc

SEQ ID NO: 145699 - DNA, 728 bp, Homo sapiens
  misc_feature: GYAE6OF01A2SG7.21.4.A04.1.454.CMB.1.raw
  modified_base (217)..(217): a, c, t, g, unknown or other
  misc_feature (217)..(217): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
tcagtcgtcgctcgcacgaccggtgctcgatttagagtagtgatcgaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggganacttggtccaggccctgggacgggtcccctggacgtaccttcctccgtgtgcagccctntgccattccaccttanacgtcgaacccanaacagtcggacgtcgggtcccgccgacgggcctaccggaagggggaacgggtcgtagggacggtcggggtccggtaccgttaagttaccgaaagggtaaacgtctaaacgaggttaaccgagtaaccgaaggaaacgtacggcgtcgtagtagtaacggaaaggtacggttacaacccgtaattcgtaacgaaagtacgtaagtaggtaactttaaccgaaaagtacctacgtaaccgttagttaacttcgtaacgaactaaaagtacgaaacgtaccgtaacccggttaaacggaaaacccggtacgggaacccgtaccggggtacccgttaaggtaatttaacgttgggtaaacggtaacgaacggtaaaaagtcggtaagggtacgttaagggttagggttaggtcgtggttggtaaacg

SEQ ID NO: 145700 - DNA, 865 bp, Homo sapiens
  misc_feature: GYAE6OF01EGAU8.21.4.A04.1.454.CMB.1.raw
tcagtcgtcgctcgcacgaccggtgctcgatttagagtagtgatcagggagctctgagagcggagccccagccccagaattcccaggtgttttcatttggtgatcagcactgaacacagaggactcaccatggagtttggctgagtcttgggttttccttgttgttatttacaaggtgtccagtgtgaggtgcagctggtggaggtcgtgggggagtacgttggtccgagcccgtgggacgggtccctagacgactcgttcctggtgacacgtcctcgtcgactacttaccctacctttcacgtacgaacccaacgaaactaggtcggtaccgttcggggtcccgaccgtaacgggtcccgtaccgggaacgggggtaacggggtcgttaggggtacgggtcggggtcccggtacgtttaaacgttaaccggaaaaggtaaacgtaaccgtaaaacgtacgtttaacgaaacggtaaacgtaaggaaacgttacccgggcggttaccggttacgttaagggtaaaagggtaaaacgggttaaccgggtttaacccaacccggtaactttacccggtaaacggtaaacggtaaacggtaacgttaagtaaaaccgtttaaaccgaaaaacggttaaccgtaacgtaaccgttaaggttaccttaacggtaacgtaaaccgtaaagtaaccggaaaaccgtaccggtaaacccggttaaaccgggaaaaacccggacgggtaaccccgaaccgggttacccggttaagtttaacttacggtttacgggtaacgttaaagaaaccggtaaaggtacggttaagggtacgttaagggttaggttaagggttcgtacgtcgggtaaaccg

SEQ ID NO: 145701 - DNA, 708 bp, Homo sapiens
  misc_feature: GYAE6OF01CNF0N.21.4.A04.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (305)..(305): a, c, t, g, unknown or other
  misc_feature (305)..(305): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccacctctcctgcagctccagccaagaattacnccaagagcctaactacgattacgcccttaggaaccagcaaggaacgcctggccaggcctccgaggttccnattctagtcgctcgggcccaagcgggaccacgtggccatccccgagtacgtaggttcaagggtcggacgtagggtcgggtacgtaggggaactaacggtacctttaccgaccttacttaccgaattaccgtaagtttacggacccgtaaggtaacccgttagggaaccgtacccgtaagtaaacggttacgttttccggacgtaaggtttacggtttaactttaccgtgttaccgaaggtacgtaaaggtttagtaacgggtaaacgtttcccgaaccgtttcgttacgggttaccgggttacccggaaccggttaaaacggggaacccgtaaagggttaaacgaaagttacggaaaacggttacgtcggtcggtactacgaccttaacgagtttcgttaccg

SEQ ID NO: 145702 - DNA, 580 bp, Homo sapiens
  misc_feature: GYAE6OF01AL0XS.21.4.A04.1.454.CMB.1.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaancgccaccctctcctgcagctccagccagaatatccagagctactacatacgcctaggtaccagcagaacgcctggccaggcctcccgaggttcccncatctatcgcgtcgggtcccagacgggccacgtggcactcccgagactaggttcaggtcggcaggtcgggtctgggactagtacttcgactctcatcattagcagacgtggacgtccgtagtaacgtcgtttcgacgtagttgtaacttacgtgtactagtctaagttagtacggtaacgttctaccgttcgttcgtccggttacggaccgtaaacgggaaccgtaagggtaacgtaaagtacggaaacggtacgtggtacggtcgtacgaccactgtcgttacg

SEQ ID NO: 145703 - DNA, 669 bp, Homo sapiens
  misc_feature: GYAE6OF01ADQP0.21.4.A04.1.454.CMB.1.raw
  modified_base (198)..(198): a, c, t, g, unknown or other
  misc_feature (198)..(198): n is a, c, g, or t
  modified_base (659)..(659): a, c, t, g, unknown or other
  misc_feature (659)..(659): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggcacctgtctttgtctcgaggggaancgccacctctcctgcagcctccagaccaagtaactactccagacgtctactacatacgccgtaggtaccagccaagacgcctggaccaggcctcccgtaggttccctactattctagtcgtccgtcgggtaccccacggacgggcctacgtcgggacctacgtacccgagtacgtacggttcgaggtcggacgtagggtcgggtacgtagggaactacgtacttcgacttcactacgttcgtaagttacgacgtacggtacgtcggacgtacctagggtaaacttcgtttacgacgttagttacggttacttcgtacgttacgaacggtgtaaggttacggtaacgggttaaccttccgtaccgttcggttacggttccgggtaaccgacggtaaacgggtaacgtaaggtaacgtaaagtacggtaagtacggtggtacgtaccgacgtaacctacggtnttcggttacg

SEQ ID NO: 145704 - DNA, 640 bp, Homo sapiens
  misc_feature: GYAE6OF01BBDGE.21.4.A04.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (305)..(305): a, c, t, g, unknown or other
  misc_feature (305)..(305): n is a, c, g, or t
  modified_base (634)..(634): a, c, t, g, unknown or other
  misc_feature (634)..(634): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctcaggccacctgtctttgctccgaaggggaaancgcccacctctccngcagctccagccaagaatactccaagagcctaactacattacgccttaggtaccaagacaagaacgccgtggccaggcctcccgagttccnactctagtcgcgtcgggacccacgacgggccacgtcggcacgtccaagtacgtaggttcagtcggcgtaggtcgggtcgtagggactagtaccttcgactctacgactactagttaacgcgtagacgtggacgtacgtaagtaagttacgtttcgagtacgttagttactttacgttcgtacgagtacgtaacgtagttaggtaacgtttccgtaaccgttgttaccggtaccggtacgggtaaccgtaaacgggtaaccgtaaagggtaagtaaacgtacggtaaaaggtaccgtaggtacggtacgtacgaacgttaacctacgttnttacgg
